US011655285B2

(12) United States Patent
Balakrishnan et al.

(10) Patent No.: US 11,655,285 B2
(45) Date of Patent: May 23, 2023

(54) HUMAN IMMUNODEFICIENCY VIRUS NEUTRALIZING ANTIBODIES

(71) Applicant: Gilead Sciences, Inc., Foster City, CA (US)

(72) Inventors: Mini Balakrishnan, Foster City, CA (US); Brian A. Carr, Foster City, CA (US); John Corbin, Oakland, CA (US); Craig S. Pace, Pacifica, CA (US); Nathan D. Thomsen, Castro Valley, CA (US); Xue Zhang, San Diego, CA (US)

(73) Assignee: Gilead Sciences, Inc., Foster City, CA (US)

( * ) Notice: Subject to any disclaimer, the term of this patent is extended or adjusted under 35 U.S.C. 154(b) by 214 days.

(21) Appl. No.: 17/110,876

(22) Filed: Dec. 3, 2020

(65) Prior Publication Data
US 2021/0155676 A1 May 27, 2021

Related U.S. Application Data

(60) Continuation of application No. 16/273,753, filed on Feb. 12, 2019, now Pat. No. 10,882,898, which is a division of application No. 15/379,157, filed on Dec. 14, 2016, now Pat. No. 10,239,935.

(60) Provisional application No. 62/267,652, filed on Dec. 15, 2015.

(51) Int. Cl.
C07K 16/10 (2006.01)
A61K 39/00 (2006.01)

(52) U.S. Cl.
CPC .... C07K 16/1063 (2013.01); A61K 2039/505 (2013.01); C07K 2317/33 (2013.01); C07K 2317/41 (2013.01); C07K 2317/51 (2013.01); C07K 2317/515 (2013.01); C07K 2317/52 (2013.01); C07K 2317/55 (2013.01); C07K 2317/56 (2013.01); C07K 2317/565 (2013.01); C07K 2317/567 (2013.01); C07K 2317/72 (2013.01); C07K 2317/732 (2013.01); C07K 2317/76 (2013.01); C07K 2317/92 (2013.01); C07K 2317/94 (2013.01)

(58) Field of Classification Search
None
See application file for complete search history.

(56) References Cited

U.S. PATENT DOCUMENTS

| | | |
|---|---|---|
| 6,815,201 B2 | 11/2004 | Pinter |
| 7,041,293 B1 | 5/2006 | Berman et al. |
| 7,317,091 B2 | 1/2008 | Lazar et al. |
| 7,662,925 B2 | 2/2010 | Lazar et al. |
| 8,039,592 B2 | 10/2011 | Lazar et al. |
| 8,088,376 B2 | 1/2012 | Chamberlain et al. |
| 8,093,357 B2 | 1/2012 | Lazar et al. |
| 8,093,359 B2 | 1/2012 | Lazar et al. |
| 8,383,109 B2 | 2/2013 | Lazar et al. |
| 8,388,955 B2 | 3/2013 | Lazar et al. |
| 8,394,925 B2 | 3/2013 | Chamberlain et al. |
| 8,546,543 B2 | 10/2013 | Lazar |
| 8,735,545 B2 | 5/2014 | Lazar et al. |
| 8,840,890 B2 | 9/2014 | Lewis et al. |
| 8,858,937 B2 | 10/2014 | Lazar et al. |
| 8,937,158 B2 | 1/2015 | Lazar et al. |
| 9,040,041 B2 | 5/2015 | Desjarlais et al. |
| 9,051,362 B2 | 6/2015 | Chan-Hui et al. |
| 9,353,187 B2 | 5/2016 | Lazar et al. |
| 9,464,131 B2 | 10/2016 | Chan-Hui et al. |
| 9,803,023 B2 | 10/2017 | Chamberlain et al. |
| 10,087,239 B2 | 10/2018 | Chan-Hui et al. |
| 10,184,000 B2 | 1/2019 | Lazar et al. |
| 10,336,818 B2 | 7/2019 | Chamberlain et al. |
| 10,584,176 B2 | 3/2020 | Lazar et al. |
| 10,882,898 B2 | 1/2021 | Balakrishnan et al. |
| 2005/0287150 A1 | 12/2005 | Ambrosino et al. |
| 2007/0292390 A1 | 12/2007 | Dimitrov et al. |
| 2008/0279879 A1 | 11/2008 | Zolla-Pazner |
| 2008/0286274 A1 | 11/2008 | Minenkova et al. |
| 2010/0215691 A1 | 8/2010 | Parks et al. |
| 2011/0044994 A1 | 2/2011 | Chan-Hui et al. |
| 2011/0223615 A1 | 9/2011 | Lewis et al. |
| 2014/0205612 A1 | 7/2014 | Chan-Hui et al. |
| 2015/0152167 A1 | 6/2015 | Ho et al. |
| 2015/0183836 A1 | 7/2015 | Sodroski et al. |
| 2016/0008374 A1 | 1/2016 | Geleziunas et al. |
| 2017/0190763 A1 | 7/2017 | Balakrishnan |
| 2018/0057570 A1 | 3/2018 | Chan-Hui et al. |
| 2020/0024330 A1 | 1/2020 | Chan-Hui et al. |

FOREIGN PATENT DOCUMENTS

| | | |
|---|---|---|
| CO | 11162444 | 11/2011 |
| CO | 13138546 | 6/2013 |
| EP | 2926830 B1 | 8/2017 |
| WO | WO-2010/056898 A2 | 5/2010 |
| WO | WO-2010/107939 A2 | 9/2010 |

(Continued)

OTHER PUBLICATIONS

Arvind Rajpal et al.: "Introduction: Antibody Structure and Function" In: "Therapeutic Fe-Fusion Proteins" Feb. 19, 2014 (Feb. 19, 2014), Wiley-VCH Verl ag GmbH & Co. KGaA, Weinheim. Germany. XP055198075, ISBN: 978-3-52-733317-2 pp. 1-44.

Australian Examination Report AU2015234345 dated Aug. 9, 2017, 10 Pages.

Bournazos et al., "Broadly Neutralizing Anti-HIV-1 Antibodies Require Fc Effector Functions for In Vivo Activity," Cell, vol. 158, No. 6, Sep. 11, 2014 pp. 1243-1253.

Brown, et al., "Tolerance of single, but not multiple, amino acid replacements in antibody VH CDR 2: a means of minimizing B cell wastage from somatic hypermutation?" Journal of Immunology, (1996) vol. 156, pp. 3285-3291.

(Continued)

Primary Examiner — Nicole Kinsey White

(57) ABSTRACT

The present invention provides novel anti-HIV antibodies with improved therapeutic properties, related pharmaceutical compositions, and methods of use thereof.

18 Claims, 32 Drawing Sheets
Specification includes a Sequence Listing.

(56) References Cited

FOREIGN PATENT DOCUMENTS

| WO | WO-2010/125162 A1 | 11/2010 |
|---|---|---|
| WO | WO-2012/030904 A2 | 3/2012 |
| WO | WO-2012/068366 A2 | 5/2012 |
| WO | WO-2012/106578 A1 | 8/2012 |
| WO | WO-2014/124457 A1 | 8/2014 |
| WO | WO-2015/048770 A2 | 4/2015 |
| WO | WO-2017/106346 A2 | 6/2017 |

OTHER PUBLICATIONS

Casadevall, et al., "Immunoglobulin isotype influences affinity and specificity" PNAS, (2012) vol. 109 No. 31, pp. 12272-12273.
Center, et al., "The Human Immunodeficiency Virus Type 1 gp120 V2 Domain Mediates gp41-Independent Intersubunit Contacts" Journal of Virology, (2000) vol. 74 No. 10, pp. 4448-4455.
Corrected Notice of Allowability dated Nov. 27, 2020 for U.S. Appl. No. 16/273,753.
European Examination Report EP10722810.8 dated Dec. 14, 2016.
European Examination Report EP16206293.9 dated Mar. 22, 2018, 5 pages.
European Search Report (partial) EP140040155 dated Jun. 22, 2015, 8 pages.
European Search Report EP11822530.9-1412/2611465 PCT/US2011/049880 dated May 2, 2014, 12 pages.
European Search Report EP14004015.5-1412/2926830 dated Oct. 9, 2015, 12 pages.
European Search Report EP16206293.9-1412 dated Apr. 21, 2017, 7 pages.
European Search Report EP17173548-1412 dated Oct. 9, 2017, 10 pages.
European Search Report EP17194834.2-1116 dated Feb. 19, 2018, 12 pages.
Examination Report dated Jul. 23, 2019 for European Appl. No. 16867376.2.
Examination Report dated Feb. 4, 2020 for European Appl. No. 16867376.2.
Examination Report dated Apr. 29, 2020 for Australian Appl. No. 2016370591.
Examination Report dated Jul. 30, 2020 for European Appl. No. 16867376.2.
Fanning, et al., "Development of the Immunoglobulin Repertoire" *Journal of Immunology and Immunopathology*, (1996) vol. 79 No. 1, pp. 1-14.
Final Office Action dated Mar. 4, 2020 for Japanese Appl. No. 2018-530831.
First Examination Report dated Mar. 20, 2019 for Australian Appl. No. 2016370591.
First Examination Report dated Apr. 30, 2019 for New Zealand Appl. No. 743713.
First Examination Report dated Jan. 28, 2021 for Australian Appl. No. 2019275625.
First Office Action dated Feb. 28, 2020 for Eurasian Appl. No. 201891186.
Form 18 Examination Report and Search Report dated Nov. 14, 2020 for ARIPO Appl. No. AP/P/2018/010843.
Gonzales N R et al. (2005), "Minimizing the immunogenicity of antibodies for clinical application", Tumor Biology, Karger, Basel, CH, vol. 26, No. 1, pp. 31-43.
Igawa T et al. (2011), "Engineering the variable region of therapeutic IgG antibodies", MABS, Landes Bioscience, US, vol. 3, No. 3, pp. 243-252.
International Preliminary Report on Patentability and Written Opinion in International Application No. PCT/US2010/027695, dated Sep. 20, 2011, 14 pages.
International Preliminary Report on Patentability and Written Opinion in International Application No. PCT/US2011/049880, dated Mar. 5, 2013, 14 pages.
International Search Report in corresponding International Application No. PCT/US2016/066658, dated Aug. 11, 2017, 6 pages.
International Search Report in International Application No. PCT/US2010/027695, dated Apr. 6, 2011, 8 pages.
International Search Report in International Application No. PCT/US2011/049880, dated Apr. 6, 2012, 6 pages.
Jefferis et al., "Human Immunoglobulin allotypes" *MABS*, vol. 1, No. 4, Jan. 1, 2009.
Julian, et al. (2013) PLoS Pathog, May 2013 9(5):e1003342.
Koefoed, et al., "Molecular characterization of the circulating anti-HIV-1 gp120-specific B cell repertoire using antibody phage display libraries generated from pre-selected HIV-1 gp120 binding PBLs" Journal of Immunological Methods, (2005) vol. 297, pp. 187-201.
Lobo E D et al. (2004), "Antibody pharmacokinetics and pharmacodynamics", Warasan Phestchasat Maha Witthayalai Mahidon—Mahidol University Journal of Pharmaceutical Science, Faculty of Pharmacy, Mahidol University, Bangkok, TH, vol. 93, No. 11, pp. 2645-2668.
Lucchese G et al. (2012), "How a single amino acid change may alter the immunological information of a peptide", Frontiers in bioscience: Elite edition, vol. 4, No. 5, pp. 1843-1852.
Mcconnell A D et al. (2014), "A general approach to antibody thermostabilization", mAbs, vol. 6, No. 5, pp. 1274-1282.
McKeating, et cl. "Characterization of Neutralizing Monoclonal Antibodies to Linear and Conformation-Dependent Epitopes within the First and Second Variable Domains of Human Immunodeficiency Virus Type 1 gpl20" Journal of Virology, (1993) vol. 67 No. 8, pp. 4932-4944.
Moulard et al., "Broadly cross-reactive HIV-1-neutralizing human monoclonal Fab selected for binding to gp120-CD4-CCR5 complexes" Proceedings of The National Academy of Sciences of the United States (PNAS), National Academy of Science, vol. 99, No. 10, May 14, 2002 pp. 6913-6918.
Non-Final Office Action dated Apr. 20, 2018 for U.S. Appl. No. 15/379,157.
Non-Final Office Action dated Apr. 1, 2020 for U.S. Appl. No. 16/273,753.
Notice of Acceptance dated Aug. 30, 2019 for Australian Appl. No. 2016370591.
Notice of Allowance dated Oct. 1, 2018 for U.S. Appl. No. 15/379,157.
Notice of Allowance dated Jan. 29, 2019 for U.S. Appl. No. 15/379,157.
Notice of Allowance dated Jul. 2, 2020 for Japanese Appl. No. 2018-530831.
Notice of Allowance dated Jul. 14, 2020 for U.S. Appl. No. 16/273,753.
Notice of Allowance dated Jul. 16, 2020 for South Korean Appl. No. 10-2018-7019806.
Notice of Allowance dated Sep. 1, 2020 for U.S. Appl. No. 16/273,753.
Notice of Allowance dated Oct. 13, 2020 for U.S. Appl. No. 16/273,753.
Notice of Last Preliminary Rejection dated Feb. 14, 2020 for South Korean Appl. No. 10-2018-7019806.
Notice of Preliminary Rejection dated Oct. 15, 2019 for South Korean Appl. No. 10-2018-7019806.
Office Action and Search Report dated Jul. 25, 2019 for Colombian Appl. No. NC2018/0006050.
Office Action and Search Report dated Aug. 20, 2020 for Chilean Appl. No. 1587-2018.
Office Action dated Apr. 9, 2019 for Canadian Appl. No. 3008442.
Office Action dated Aug. 20, 2019 for Japanese Appl. No. 2018-530831.
Office Action dated Sep. 22, 2019 for Israeli Appl. No. 259832.
Office Action dated Jan. 13, 2020 for Chilean Appl. No. 1587-2018.
Office Action dated Jan. 22, 2020 for Colombian Appl. No. NC2018/0006050.
Office Action dated May 28, 2020 for Canadian Appl. No. 3008442.
Office Action dated Aug. 24, 2020 for Argentinian Appl. No. 20160103833.
Office Action dated Sep. 24, 2020 for Indonesian Appl. No. PID-2018-05132.

(56) References Cited

OTHER PUBLICATIONS

Office Action dated Sep. 29, 2020 for Dominican Republic Appl. No. P2018-0146.
Office Action dated Oct. 2, 2020 for Thai Appl. No. 1801003482.
Office Action dated Dec. 11, 2020 for Ukranian Appl. No. a 2018 06361.
Office Action dated Dec. 30, 2020 for Saudi Arabian Appl. No. 518391778.
Pantophlet et al., "GP120: Target for neutralizing HIV-1 antibodies" Annual Review of Immunology, vol. 24, 2006, pp. 739-769.
Pejchal, et al., "Structure and function of broadly reactive antibody PG16 reveal an H3 subdomain that mediates potent neutralization of HIV-1" PNAS, (2010) vol. 107 No. 25, pp. 11483-11488.
Second Examination Report dated May 31, 2019 for Australian Appl. No. 2016370591.
Second Examination Report dated Nov. 12, 2019 for New Zealand Appl. No. 743713.
Sok D. et al. (2013), "The Effects of Somatic Hypermutation on Neutralization and Binding in the PGT121 Family of Broadly Neutralizing HIV Antibodies", PLOS Pathogens, vol. 9, No. 11, e1003754.
Stiegler et al., "A potent cross-clade neutralizing human monoclonal antibody against a novel epitope on gp41 of human immunodeficiency virus type 1" Aids Research and Human Retroviruses, vol. 17:,No. 18, Dec. 10, 2001 pp. 1757-1765.
Trkola et al., "Human monoclonal antibody 2G12 defines a distinctive neutralization epitope on the gp 120 glycoprotein of human immunodeficiency virus type 1 " *Journal of Virology, Journal of Virology, the American Society for Microbiology*, us, vol. 70, No. 2, Feb. 1, 1996, pp. 1100-1108.
Walker et al., "Broad neutralization coverage of HIV by multiple highly potent antibodies" Nature vol. 477, No. 7365 Sep. 22, 2011, pp. 466-470.
Walker, et al., "Broad and Potent Neutralizing Antibodies from an African Donor Reveal a New HIV-1 Vaccine Target" Science, (2009) vol. 326, pp. 285-291.
Walker, et al., Supporting Online Material for "Broad and Potent Neutralizing Antibodies from an African Donor Reveal a New HIV-1 Vaccine Target" Science, (2009) No. 1178746, 27 pages.
Winkler, et al., "Changing the Antigen Binding Specificity by Single Point Mutations of an Anti-p24 (HIV-1) Antibody" Journal of Immunology, (2000) vol. 165, pp. 4505-4514.
Written Opinion in corresponding International Application No. PCT/US2016/066658, dated Aug. 11, 2017, 10 pages.
Xiang, et al. "Framework Residues 71 and 93 of the Chimeric B72.3 Anitobdy are Major Determinants of the Conformation of Heavy-chain Hypervariable Loops" J. Mo. Biol., (1995) vol. 253, pp. 385-390.
Xiang, et al., "Modification in Framework Region I Results in a Decreased Affinity of Chimeric Anti-Tag 72 Antibody", Molecular Immunology, (1991) vol. 28, No. 1/2 pp. 141-148.
Zalevsky et al., "Enhanced antibody half-life improves in vivo activity," Nature Biotechnology vol. 28, No. 2, Feb. 1, 2010, pp. 157-159.
Zhang et al., "Cross-reactive human immunodeficiency virus type 1-neutralizing human monoclonal antibody that recognizes a novel conformational epitope on gp41 and lacks reactivity against self-antigens" Journal of Virology, vol. 82, No. 14, Jul. 2008, pp. 6869-6879.
Zhang et al., "Identification and Characterization of a New Cross-Reactive Human Immunodeficiency Virus Type 1-Neutralizing Human Monoclonal Antibody" Journal of Virology, The American Society for Microbiology, vol. 78, No. 17, Sep. 1, 2004, pp. 9233-9242.
Zhang et al., "Novel Approaches for Identification of Broadly Cross-Reactive HIV-1 Neutralizing Human Monoclonal Antibodies and Improvement of Their Potency" Current Pharmaceutical Design, vol. 13, No. 2, Jan. 1, 2007, pp. 203-212.
Extended European Search Report dated Apr. 4, 2022 for European Appl. No. 21192543.3.
First Examination Report dated May 31, 2021 for Indian Appl. No. 201817026158.
First Examination Report dated Dec. 28, 2022 for Malaysian Appl. No. PI2021003644.
First Examination Report dated Dec. 12, 2022 for New Zealand Appl. No. 758691.
Franchini G. and Bosch M. L., (1989) "Genetic relatedness of the human immunodeficiency viruses type 1 and 2 (HIV-1, HIV-2) and the simian immunodeficiency virus (SIV)", Annal. NY Acad. Sci 554(1): 81-87.
He L. et al., (2014), "Toward a more accurate view of human B-cell repertoire by next-generation sequencing, unbiased repertoire capture and single-molecule barcoding", Scientific Reports, vol. 4, No. 1.
Maartens G. et al., (2014), "HIV infection: epidemiology, pathogenesis, treatment, and prevension", The Lancet, 384:258-271.
Notice of Allowance dated Sep. 28, 2020 for Canadian Appl. No. 3008442.
Notice of Allowance dated May 14, 2021 for Taiwanese Appl. No. 105141486.
Notice of Allowance dated Aug. 2, 2021 for Japanese Appl. No. 2020-085079.
Notice of Allowance dated Nov. 29, 2021 for Vietnamese Appl. No. 1-2018-02985.
Notice of Allowance dated Dec. 21, 2021 for Ukranian Appl. No. a201806361.
Notice of Allowance dated Jan. 18, 2022 for Chinese Appl. No. 2016800798235.
Notice of Allowance dated Aug. 4, 2022 for Japanese Appl. No. 2021-137876.
Notice of Eligibility for Grant and Supplementary Examination Report dated Jul. 8, 2021 for Singaporean Appl. No. 11201804787U.
Notification of Decision to Grant and Search Report dated Feb. 15, 2021 for ARIPO Appl. No. AP/P/2018/010843.
Notification of Decision to Grant and Search Report dated Dec. 8, 2022 for ARIPO Appl. No. AP/P/2021/012935.
Office Action and Search Report dated Jan. 29, 2021 for Taiwanese Appl. No. 105141486.
Office Action and Search Report dated Apr. 2, 2021 for Chinese Appl. No. 2016800798235.
Office Action and Search Report dated Jul. 19, 2022 for Taiwanese Appl. No. 110130315.
Office Action dated Mar. 30, 2021 for Brazilian Appl. No. BR112018012164-9.
Office Action dated Jun. 8, 2021 for Japanese Appl. No. 2020-085079.
Office Action dated Jul. 7, 2021 for Dominican Republic Appl. No. P2018-0146.
Office Action dated Nov. 22, 2021 for Israeli Appl. No. 259832.
Office Action dated May 9, 2022 for Mexican Appl. No. MX/a/2018/007288.
Office Action dated May 24, 2022 for Dominican Republic Appl. No. P2018-0146.
Office Action dated Jun. 20, 2022 for Egyptian Appl. No. 955/2018.
Office Action dated Jul. 4, 2022 for Chilean Appl. No. 202100228.
Office Action dated Oct. 24, 2022 for Chilean Appl. No. 202100228.
Rosa S et al. (2021), "mRNA vaccines manufacturing: Challenges and bottlenecks", Vaccine 39:2190-2200.
Second Office Action dated Dec. 23, 2020 for Eurasian Appl. No. 201891186.
Second Office Action dated Nov. 12, 2021 for Ukranian Appl. No. a201806361.
Stevenson M., (2003) "HIV-1 pathogenesis", Nat. Med. 9(7):853-860.
Third Office Action dated Dec. 14, 2021 for Eurasian Appl. No. 201891186.

PGT-121 LO6 heavy chain variable domain sequence

| Q | M | Q | L | Q | E | S | G | P | G | L | V | K | P | S | E | T | L | S | L | T | C | S | V | S | G | A | S | I | S |
|---|---|---|---|---|---|---|---|---|---|---|---|---|---|---|---|---|---|---|---|---|---|---|---|---|---|---|---|---|---|
| 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 |

| D | S | Y | W | S | W | I | R | R | S | P | G | K | G | L | E | W | I | G | Y | V | H | K | S | G | D | T | N | Y |
|---|---|---|---|---|---|---|---|---|---|---|---|---|---|---|---|---|---|---|---|---|---|---|---|---|---|---|---|---|
| 31 | 32 | 33 | 34 | 35 | 36 | 37 | 38 | 39 | 40 | 41 | 42 | 43 | 44 | 45 | 46 | 47 | 48 | 49 | 50 | 51 | 52 | 53 | 54 | 55 | 56 | 57 | 58 | 59 |

| P | S | L | K | S | R | V | N | L | S | L | D | T | S | K | N | Q | V | S | L | V | A | T | A | S | A | D | T | A | D |
|---|---|---|---|---|---|---|---|---|---|---|---|---|---|---|---|---|---|---|---|---|---|---|---|---|---|---|---|---|---|
| 61 | 62 | 63 | 64 | 65 | 66 | 67 | 68 | 69 | 70 | 71 | 72 | 73 | 74 | 75 | 76 | 77 | 78 | 79 | 80 | 81 | 82 | 82A | 82B | 82C | 83 | 84 | 85 | 86 | 87 |

| G | K | Y | Y | C | A | R | T | L | H | G | R | R | I | Y | G | I | V | A | F | N | E | W | F | T | Y | F | Y | M | D |
|---|---|---|---|---|---|---|---|---|---|---|---|---|---|---|---|---|---|---|---|---|---|---|---|---|---|---|---|---|---|
| 88 | 89 | 90 | 91 | 92 | 93 | 94 | 95 | 96 | 97 | 98 | 99 | 100 | 100A | 100B | 100C | 100D | 100E | 100F | 100G | 100H | 100I | 100J | 100K | 100L | 100M | 100N | 100O | 100P | 101 |

| V | T | V | S | S |
|---|---|---|---|---|
| 102 | 109 | 110 | 111 | 112 | 113 |

PGT-121 LO6 light chain variable domain sequence

| - | - | - | - | - | S | D | I | S | V | A | P | G | E | T | A | R | I | S | C | G | E | K | S | L | G | S | R |
|---|---|---|---|---|---|---|---|---|---|---|---|---|---|---|---|---|---|---|---|---|---|---|---|---|---|---|---|
| 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 |

| A | V | Q | W | Y | Q | H | R | A | G | Q | A | P | S | L | I | I | Y | N | N | Q | D | R | P | S | G | I | P | E | R |
|---|---|---|---|---|---|---|---|---|---|---|---|---|---|---|---|---|---|---|---|---|---|---|---|---|---|---|---|---|---|
| 31 | 32 | 33 | 34 | 35 | 36 | 37 | 38 | 39 | 40 | 41 | 42 | 43 | 44 | 45 | 46 | 47 | 48 | 49 | 50 | 51 | 52 | 53 | 54 | 55 | 56 | 57 | 58 | 59 | 60 |

| F | S | G | S | P | D | S | P | F | G | T | T | A | T | L | T | I | S | V | E | A | G | D | E | A | D | Y | Y | C |
|---|---|---|---|---|---|---|---|---|---|---|---|---|---|---|---|---|---|---|---|---|---|---|---|---|---|---|---|---|
| 62 | 63 | 64 | 65 | 66 | 67 | 67a | 67b | 67c | 68 | 69 | 70 | 71 | 72 | 73 | 74 | 75 | 76 | 77 | 78 | 79 | 80 | 81 | 82 | 83 | 84 | 85 | 86 | 87 |

| H | I | W | D | S | R | V | P | T | K | W | V | F | G | G | G |
|---|---|---|---|---|---|---|---|---|---|---|---|---|---|---|---|
| 89 | 90 | 91 | 92 | 93 | 94 | 95 | 95a | 95b | 95c | 96 | 97 | 98 | 103 | 107 | 108 |

HUMAN IMMUNODEFICIENCY VIRUS NEUTRALIZING ANTIBODIES

CROSS-REFERENCE TO RELATED APPLICATIONS

This application is a Continuation of U.S. application Ser. No. 16/273,753 filed on Feb. 12, 2019, issued as U.S. Pat. No. 10,882,898 on Jan. 5, 2021, which is a Division of U.S. application Ser. No. 15/379,157, filed on Dec. 14, 2016, issued as U.S. Pat. No. 10,239,935 on Mar. 26, 2019, which claims the benefit of U.S. Provisional Application Ser. No. 62/267,652, filed Dec. 15, 2015, which are hereby incorporated by reference in their entireties.

STATEMENT REGARDING SEQUENCE LISTING

The Sequence Listing associated with this application is provided in text format in lieu of a paper copy, and is hereby incorporated by reference into the specification. The name of the text file containing the Sequence Listing is 1121_US_PCDC_SL.txt. The text file created on Feb. 2, 2021 is 658,248 bytes and submitted electronically via EFS-Web.

FIELD OF THE INVENTION

This invention relates to antibodies and antigen-binding fragments thereof for the treatment and prevention of human immunodeficiency virus (HIV) infection. In particular, the present invention provides novel anti-HIV antibodies and antigen-binding fragments thereof, including broadly neutralizing anti-HIV antibodies and antigen-binding fragments thereof, pharmaceutical compositions containing such antibodies and fragments thereof, and methods for using these antibodies and fragments thereof to reduce HIV replication and in the treatment and prevention of HIV infection.

BACKGROUND OF THE INVENTION

Human immunodeficiency virus (HIV) infection and related diseases are a major public health problem worldwide. Most currently approved therapies for HIV infection target the viral reverse transcriptase, protease enzymes, and integrase but resistance of HIV to these existing drugs, long term toxicity, and lack of patient adherence to daily dosing regimens have proven to be problems associated with these therapies. Therefore, it is important to discover and develop new HIV drugs.

WO2012/030904 describes human anti-HIV antibodies derived from memory B cells of HIV-infected donors, which are capable of inhibiting infection by HIV-1 species from a plurality of clades. However, the therapeutic use of these antibodies is limited due to issues with immunogenicity, pharmacokinetics, antigen specificity, effector function, and manufacturing. Accordingly, there is a need in the art for novel anti-HIV antibodies with advantageous properties for therapeutic uses.

BRIEF SUMMARY OF THE INVENTION

The present invention provides, inter alia, compositions and methods for treating or preventing HIV.

In one embodiment, the present invention includes an isolated monoclonal antibody, or an antigen-binding fragment thereof, comprising one or more of the heavy chain complementary determining regions (CDRs) and one or more of the light chain CDRs of the PGT121 LO6 antibody (using Kabat, IMGT, Chothia, or Honegger numbering). In some embodiments, the disclosure provides for an antibody, or an antigen-binding fragment thereof, comprising the heavy chain complementary determining regions 1-3 (CDRs 1-3) set forth in SEQ ID NOs: 362, 364 and 367 and the light chain CDRs 1-3 set forth in SEQ ID NOs: 395, 396 and 397, wherein the antibody or antigen-binding fragment thereof comprises zero to eight (or zero to four) amino acid substitutions within the CDRs, and wherein the antibody or antigen-binding fragment thereof comprises one or more of the following: a IgG1m17 allotype heavy chain; a Lambda2 light chain; a heavy chain constant region comprising one or more of the following amino acid substitutions: Ala at position 236, Asp at position 239, Leu at position 330, Glu at position 332, Leu at position 428, and Ser at position 434 (using EU numbering); and a heavy chain variable region comprising one or more of: Ser-Ser-Val or Thr-Gly-Val at positions 82a-82c, Gln at position 39, Asn at position 60, His at position 68, any one of Lys, His or Thr at position 105, Leu at position 2, Ala at position 32, and Ala at position 95 (using Kabat numbering). In particular embodiments, the antibody or antigen binding fragment thereof comprises two or more of the heavy chain complementary determining regions (CDRs) and two or more of the light chain CDRs of the PGT121 LO6 antibody (using Kabat, IMGT, Chothia, or Honegger numbering). In particular embodiments, the antibody or antigen binding fragment thereof comprises all three of the heavy chain complementary determining regions (CDRs) and all three of the light chain CDRs of the PGT121 LO6 antibody (using Kabat, IMGT, Chothia, or Honegger numbering). In particular embodiments, the monoclonal antibody or antigen-binding fragment thereof, comprises the IgG1m17 allotype heavy chain. In particular embodiments, the heavy chain constant region comprises Lys at position 214, Glu at position 356, Met at position 358, and Ala at position 431 (using EU numbering). In particular embodiments, the monoclonal antibody comprises a heavy chain constant region (Fc) of any one of the following antibodies: PGT121.42, PGT121.43, PGT121.60, PGT121.61, PGT121.54, PGT121.55, PGT121.64, and PGT121.65. In particular embodiments of any of the antibodies or antigen-binding fragments thereof described herein, the heavy chain constant region (Fc) is set forth in any of SEQ ID NOs: 252, 255, 266, 267, 268, 269, 272, and 273. In particular embodiments, the monoclonal antibody or antigen-binding fragment thereof comprises a Lambda2 light chain. In certain embodiments, the light chain comprises one or more of the following amino acid substitutions (using Kabat numbering): Arg at position 67b, Pro at position 67c, and Lys at position 103. In one embodiments, the light chain comprises one or more of the following amino acid substitutions (using Kabat numbering scheme in FIG. 1): Arg at position 67b, Pro at position 67c, and Lys at position 103. In particular embodiments, the monoclonal antibody comprises a light chain of any one of the following antibodies: PGT121.42, PGT121.43, PGT121.60, PGT121.61, PGT121.54, PGT121.55, PGT121.64, and PGT121.65. In particular embodiments of any of the antibodies or antigen-binding fragments thereof described herein, the light chain is set forth in any of SEQ ID NOs: 338, 341, 352, 353, 354, 355, 358, and 359. In particular embodiments, the monoclonal antibody or antigen-binding fragment thereof comprises a heavy chain constant region comprises one or more of the following amino acid substitutions (using EU numbering): Ala at position 236, Asp at position 239, Leu at position 330, Glu at position 332, Leu at position 428, and Ser at position 434. In particular embodiments, the heavy chain constant region comprises Ala at position 236, Asp at position 239, Leu at position 330, and Glu at position 332. In particular embodiments, the heavy chain constant region comprises Leu at position 428 and Ser at position 434. In certain embodiments, the heavy chain constant region comprises Ala at position 236, Asp at position 239, Leu at position 330, Glu at position 332, Leu at position 428, and Ser at position 434 (using EU numbering). In particular embodiments, the monoclonal antibody or antigen-binding fragment thereof, comprises a heavy chain constant region of any one of the following antibodies: PGT121.42, PGT121.43, PGT121.60, PGT121.61, PGT121.54, PGT121.55, PGT121.64, and PGT121.65. In certain embodiments, the monoclonal antibody, or antigen-binding fragment thereof, comprises a heavy chain variable region (Fab) comprising one or more of the following amino acid substitutions: Ser-Ser-Val or Thr-Gly-Val at positions 82a-82c, Gln at position 39, Asn at position 60, His at position 68, any one of Lys, His or Thr at position 105, Leu at position 2, Ala at position 32, and Ala at position 95 (using Kabat numbering). In particular embodiments, the heavy chain variable region comprises Ser-Ser-Val or Thr-Gly-Val at positions 82a-82c (using Kabat numbering). In particular embodiments, the heavy chain variable region comprises Asn at position 60, His at position 68, and Lys, His or Thr at position 105 (using Kabat numbering). In certain embodiments, the heavy chain variable region (Fab) comprises: Ser-Ser-Val or Thr-Gly-Val at positions 82a-82c, Gln at position 39, Asn at position 60, His at position 68, and Lys, Thr or His at position 105 (using Kabat numbering). In certain embodiments, the monoclonal antibody or antigen-binding fragment thereof comprises a heavy chain variable region provided in Table 1. In particular embodiments, the monoclonal antibody or antigen-binding fragment thereof comprises a heavy chain constant region provided in Table 1. In particular embodiments, the monoclonal antibody or antigen-binding fragment thereof comprises a light chain or variable region thereof provided in Table 1.

In a related embodiment, the present invention includes an isolated polynucleotide encoding the monoclonal antibody or antigen-binding fragment thereof of the invention, or the heavy chain or light chain of the monoclonal antibody.

In a further related embodiment, the present invention includes a vector comprising a polynucleotide of the invention.

In another embodiment, the present invention includes a cell comprising a polynucleotide or vector of the invention. In particular embodiments, the cell is a mammalian, bacterial or yeast cell.

In yet another embodiment, the present invention includes a pharmaceutical composition comprising a monoclonal antibody or fragment thereof of the present invention, a polynucleotide of the present invention, or a vector of the present invention. In particular embodiments, the pharmaceutical composition comprises a pharmaceutically acceptable carrier, excipient or diluent.

In another related embodiment, the present invention includes a method of treating or preventing human immunodeficiency virus (HIV) in a subject in need thereof, comprising providing to the subject an effective amount of a pharmaceutical composition of the invention. In particular embodiments, a second therapeutic agent is also provided to the subject. In certain embodiments, the second therapeutic agent is an anti-viral agent.

In a further embodiment, the present invention includes a method of producing a monoclonal antibody or antigen-binding fragment thereof of the invention, comprising recombinantly expressing the monoclonal antibody or antigen-binding fragment thereof in a cell of the invention.

BRIEF DESCRIPTION OF THE DRAWINGS

FIG. 1 shows the amino acid sequences of the heavy chain variable domain and light chain variable domain of the PGT-121 LO6 antibody with the corresponding Kabat numbering annotation shown below each amino acid. Amino acid deletions are indicated with a "–". Amino acid insertions are indicated with lowercase letters next the amino acid number.

FIG. 29A: fold increase in potency of individual PGT121 Fab variants versus PGT121 WT for R5 viruses and X4 & D/M viruses. FIG. 29B: fold more potent or fold change ($IC_{50}$) of PGT121 variants over PGT121 WT against R4 viruses or R5 viruses. R5 viruses=R5-tropic viruses, preferentially uses CCR5 receptor; X4=R4-tropic viruses, preferentially uses CXCR4 receptor; D/M viruses=Dual/Mixed, showing both R5 and X4 tropism.

DETAILED DESCRIPTION OF THE INVENTION

Figure 2:
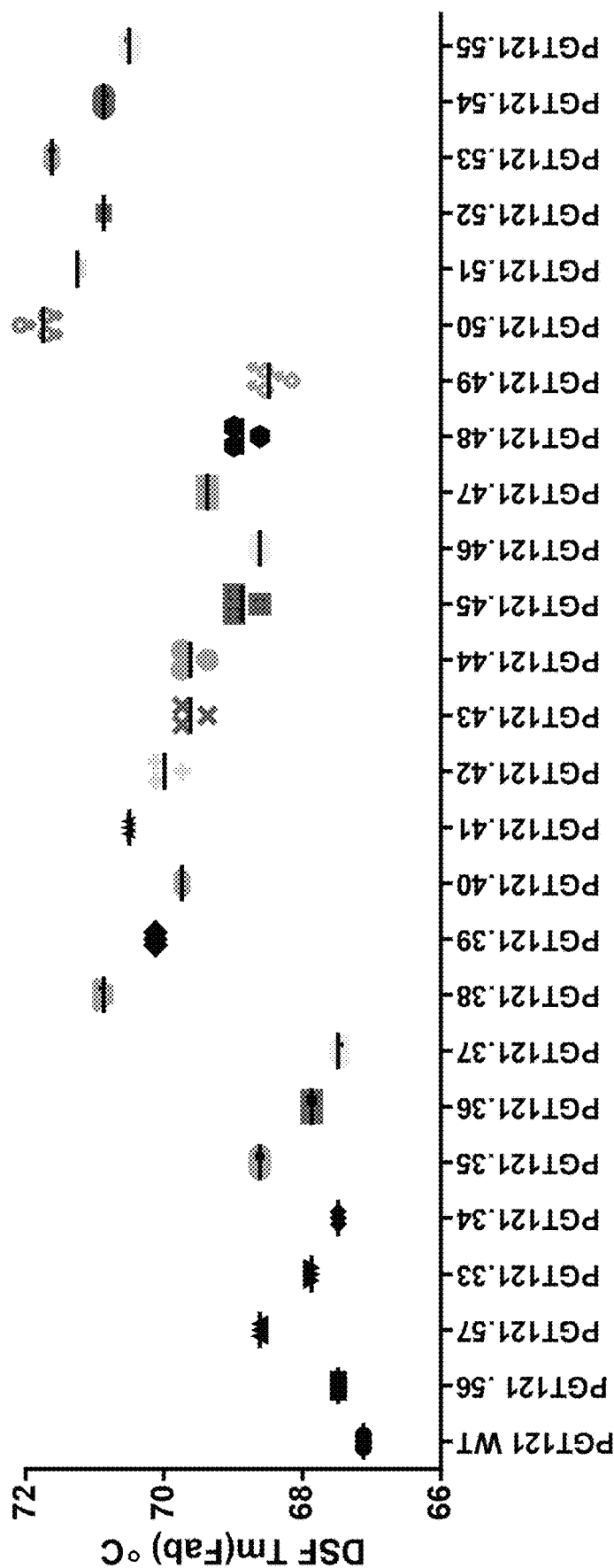
FIG. 2 is a graph showing the Tm of the Fab domain as determined by DSF for PGT121 WT and selected variants. All variants tested have improved thermal stability as compared to PGT121 WT, as indicated by a higher Tm.

The present invention is based, in part, on the identification of novel neutralizing anti-HIV antibodies with advantageous properties for therapeutic use. The present invention provides these antibodies, and antigen-binding fragments thereof, as well as related pharmaceutical compositions and methods of use thereof, e.g., for the treatment and prevention of HIV and related diseases and disorders.

Definitions and Abbreviations

The words "a" and "an" denote one or more, unless specifically noted.

By "about" is meant a quantity, level, value, number, frequency, percentage, dimension, size, amount, weight or length that varies by as much as 30, 25, 20, 15, 10, 9, 8, 7, 6, 5, 4, 3, 2 or 1% to a reference quantity, level, value, number, frequency, percentage, dimension, size, amount, weight or length. In any embodiment discussed in the context of a numerical value used in conjunction with the term "about," it is specifically contemplated that the term about can be omitted.

Unless the context requires otherwise, throughout the present specification and claims, the word "comprise" and variations thereof, such as, "comprises" and "comprising" are to be construed in an open, inclusive sense, that is as "including, but not limited to". Where the terms "comprise" or "comprising" are used herein, it is understood that the invention further includes embodiments wherein these terms are replaced with "consist of" or "consist essentially of" or "consisting of" or "consisting essentially of."

By "consisting of" is meant including, and limited to, whatever follows the phrase "consisting of." Thus, the phrase "consisting of" indicates that the listed elements are required or mandatory, and that no other elements may be present.

By "consisting essentially of" is meant including any elements listed after the phrase, and limited to other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they affect the activity or action of the listed elements.

Reference throughout this specification to "one embodiment" or "an embodiment" means that a particular feature, structure or characteristic described in connection with the embodiment is included in at least one embodiment of the present invention. Thus, the appearances of the phrases "in one embodiment" or "in an embodiment" in various places throughout this specification are not necessarily all referring to the same embodiment. Furthermore, the particular features, structures, or characteristics may be combined in any suitable manner in one or more embodiments.

An "increased" or "enhanced" amount is typically a "statistically significant" amount, and may include an increase that is 1.1, 1.2, 1.3, 1.4, 1.5, 1.6, 1.7, 1.8, 1.9, 2, 2.5, 3, 3.5, 4, 4.5, 5, 6, 7, 8, 9, 10, 15, 20, 30, 40, or 50 or more times (e.g., 100, 500, 1000 times) (including all integers and decimal points in between and above 1, e.g., 2.1, 2.2, 2.3, 2.4, etc.) an amount or level described herein. It may also include an increase of at least 10%, at least 20%, at least 30%, at least 40%, at least 50%, at least 60%, at least 70%, at least 80%, at least 90%, at least 100%, at least 150%, at least 200%, at least 500%, or at least 1000% of an amount or level described herein.

A "decreased" or "reduced" or "lesser" amount is typically a "statistically significant" amount, and may include a decrease that is about 1.1, 1.2, 1.3, 1.4, 1.5, 1.6 1.7, 1.8, 1.9, 2, 2.5, 3, 3.5, 4, 4.5, 5, 6, 7, 8, 9, 10, 15, 20, 30, 40, or 50 or more times (e.g., 100, 500, 1000 times) (including all integers and decimal points in between and above 1, e.g., 1.5, 1.6, 1.7. 1.8, etc.) an amount or level described herein. It may also include a decrease of at least 10%, at least 20%, at least 30%, at least 40%, at least 50%, at least 60%, at least 70%, at least 80%, or at least 90%, at least 100%, at least 150%, at least 200%, at least 500%, or at least 1000% of an amount or level described herein.

A "composition" can comprise an active agent, e.g., a contrast agent and a carrier, inert or active, e.g., a pharmaceutically acceptable carrier, diluent or excipient. A composition may be a pharmaceutical composition. In particular embodiments, the compositions are sterile, substantially free of endotoxins or non-toxic to recipients at the dosage or concentration employed.

"Pharmaceutically acceptable carrier, diluent or excipient" includes without limitation any adjuvant, carrier, excipient, glidant, sweetening agent, diluent, preservative, dye/colorant, flavor enhancer, surfactant, wetting agent, dispersing agent, suspending agent, stabilizer, isotonic agent, solvent or emulsifier which has been approved by the United States Food and Drug Administration as being acceptable for use in humans or domestic animals.

The terms "mammal" and "subject" includes human and non-human mammals, such as, e.g., a human, mouse, rat, rabbit, monkey, cow, hog, sheep, horse, dog, and cat.

The term "buffer" as used herein denotes a pharmaceutically acceptable excipient, which stabilizes the pH of a pharmaceutical preparation. Suitable buffers are well known in the art. Suitable pharmaceutically acceptable buffers include but are not limited to acetate-buffers, histidine-buffers, citrate-buffers, succinate-buffers, tris-buffers and phosphate-buffers. In certain embodiments, the concentration of the buffer is from about 0.01 mM to about 1000 mM, about 0.1 mM to about 1000 mM, about 0.1 mM to about 500 mM, about 0.1 to about 200 mM, about 0.1 to about 100 mM, about 1 mM to about 1000 mM, about 1 mM to about 500 mM, about 1 mM to about 200 mM, about 1 mM to about 100 mM, about 1 mM to about 50 mM, about 2 mM to about 60 mM, about 4 mM to about 60 mM, or about 4 mM to about 40 mM, about 5 mM to about 20 mM, or about 5 mM to about 25 mM.

"Optional" or "optionally" means that the subsequently described event of circumstances may or may not occur, and that the description includes instances where said event or circumstance occurs and instances in which it does not.

"Pharmaceutical composition" refers to a formulation of a compound and a medium generally accepted in the art for the delivery of the biologically active compound to mammals, e.g., humans. Such a medium may include any pharmaceutically acceptable carriers, diluents or excipients therefore.

"Effective amount" or "therapeutically effective amount" refers to that amount of an antibody or antigen-binding fragment thereof of the invention that, when administered alone or in combination with another therapeutic agent to a cell, tissue, or subject is sufficient to effect treatment or a beneficial result in the subject. The amount which constitutes an "effective amount" will vary depending on the antibody or antigen-binding fragment thereof and its specific use, and potentially also the condition and its severity, the manner of administration, and the age of the subject to be treated, but can be determined routinely by one of ordinary skill in the art having regard to his own knowledge and to this disclosure. A therapeutically effective dose further refers to that amount of the antibody or antigen-binding fragment thereof sufficient to treat, prevent or ameliorate an infection or disease condition or the progression of an infection or disease, and that amount sufficient to effect an increase in rate of treatment, healing, prevention or amelioration of such conditions. When applied to an individual antibody or antigen-binding fragment thereof administered alone, a therapeutically effective dose refers to that active ingredient alone. When applied to a combination, a therapeutically effective dose refers to combined amounts of the active ingredients that result in the therapeutic effect, whether administered in combination, serially or simultaneously.

"Treat," "treating" or "treatment" as used herein covers the treatment of the disease, injury, or condition of interest, e.g., HIV-1 infection, in a subject, e.g., a mammal, such as a human, having the disease or condition of interest, and includes: (i) inhibiting progression of the disease, injury, or condition, i.e., arresting its development; (ii) reducing or relieving the disease, injury, or condition, i.e., causing regression of the disease or condition; or (iii) relieving the symptoms resulting from the disease, injury, or condition. As used herein, the terms "disease," "disorder," and "condition" may be used interchangeably. As used herein, "inhibition," "treatment," "treating," and "ameliorating" are used interchangeably and refer to, e.g., stasis of symptoms, prolongation of survival, partial or full amelioration of symptoms, and partial or full eradication of a condition, disease or disorder.

As used herein, 'prevent" or "prevention" includes (i) preventing or inhibiting the disease, injury, or condition from occurring in a subject, in particular, when such subject is predisposed to the condition but has not yet been diagnosed as having it; or (ii) reducing the likelihood that the disease, injury, or condition will occur in the subject.

As used herein, the term "antibody" means an isolated or recombinant binding agent that comprises the necessary variable region sequences to specifically bind an antigenic epitope. Therefore, an antibody is any form of antibody or fragment thereof that exhibits the desired biological activity, e.g., binding the specific target antigen. Thus, it is used in the broadest sense and specifically covers monoclonal antibodies (including full-length monoclonal antibodies), polyclonal antibodies, human antibodies, humanized antibodies, chimeric antibodies, nanobodies, diabodies, multispecific antibodies (e.g., bispecific antibodies), and antibody fragments including but not limited to scFv, Fab, and $Fab_2$, so long as they exhibit the desired biological activity.

The term "human antibody" refers to antibodies containing sequences of human origin, except for possible non-human CDR regions, and does not imply that the full structure of an Ig molecule be present, only that the antibody has minimal immunogenic effect in a human.

"Antibody fragments" comprise a portion of an intact antibody, for example, the antigen-binding or variable region of the intact antibody. Examples of antibody fragments include Fab, Fab', F(ab')2, and Fv fragments; diabodies; linear antibodies (e.g., Zapata et al., Protein Eng. 8(10): 1057-1062 (1995)); single-chain antibody molecules (e.g., scFv); and multispecific antibodies formed from antibody fragments. Papain digestion of antibodies produces two identical antigen-binding fragments, called "Fab" fragments, each with a single antigen-binding site, and a residual "Fc" fragment, a designation reflecting the ability to crystallize readily. Pepsin treatment yields an F(ab')2 fragment that has two antigen combining sites and is still capable of cross-linking antigen.

"Fv" is the minimum antibody fragment which contains a complete antigen-recognition and -binding site. This region consists of a dimer of one heavy- and one light-chain variable domain in tight, non-covalent association. It is in this configuration that the three CDRS of each variable domain typically interact to define an antigen-binding site on the surface of the $V_H$-$V_L$ dimer. Generally, the six CDRs collectively confer antigen-binding specificity to the antibody, although there are examples of antigen-binding specificity being maintained when one or more of the six CDRs are deleted or modified, e.g., by altering the amino acid sequence of the one or more CDRs, e.g., by amino acid insertion, deletion or substitution. In addition, even a single variable domain (or half of an Fv comprising only three CDRs specific for an antigen) has the ability to recognize and bind antigen, although at a lower affinity than the entire binding site. Residues other than those present in the CDRs may also be important for or play a role in antigen binding and/or specificity as shown for PGT121 and closely related somatic variants which interact with the gp120 antigen using residues in light chain framework 3 (Julien et al. Science 342:1477-83 (2013); Julien et al. PLOS Pathog. 9: e1003342 (2013)) These residues in part arise from an unusual three amino acid insertion which extends an otherwise short surface loop in PGT121 and related somatic variants (e.g. PGT122, PGT123, PGT124, PGT133, PGT134) that contacts both the N332 linked glycan and protein residues on HIV Env, effectively forming an additional (e.g. a fourth) complementarity determining region (CDR) loop in the PGT121 light chain between LC CDRs 2 and 3.

The term "hypervariable region" refers to the amino acid residues of an antibody that are typically responsible for antigen-binding. The hypervariable region generally comprises amino acid residues from a "complementarity determining region" or "CDR" (e.g., around about residues 24-34 (L1), 50-56 (L2) and 89-97 (L3) in the $V_L$, and around about 31-35 (H1), 50-65 (H2) and 95-102 (H3) in the $V_H$ when numbered in accordance with the Kabat numbering system; Kabat et al., Sequences of Proteins of Immunological Interest, 5th Ed. Public Health Service, National Institutes of Health, Bethesda, Md. (1991)); and/or those residues from a "hypervariable loop" (e.g., residues 24-34 (L1), 50-56 (L2) and 89-97 (L3) in the $V_L$, and 26-32 (H1), 52-56 (H2) and 95-101 (H3) in the $V_H$ when numbered in accordance with the Chothia numbering system; Chothia and Lesk, J. Mol. Biol. 196:901-917 (1987)); and/or those residues from a "hypervariable loop" VCDR (e.g., residues 27-38 (L1), 56-65 (L2) and 105-120 (L3) in the $V_L$, and 27-38 (H1), 56-65 (H2) and 105-120 (H3) in the $V_H$ when numbered in accordance with the IMGT numbering system; Lefranc, M. P. et al. Nucl. Acids Res. 27:209-212 (1999), Ruiz, M. e al. Nucl. Acids Res. 28:219-221 (2000)). Optionally, the antibody has symmetrical insertions at one or more of the following points 28, 36 (L1), 63, 74-75 (L2) and 123 (L3) in the $V_L$, and 28, 36 (H1), 63, 74-75 (H2) and 123 (H3) in the $V_H$ when numbered in accordance with AHo; Honneger, A. and Plunkthun, A. J. Mol. Biol. 309:657-670 (2001)).

The "Fab" fragment is a region on an antibody that binds to antigens. It is composed of one constant and one variable domain of each of the heavy and light chain. These domains shape the paratope—the antigen-binding site—at the amino terminal end of the monomer. The two variable domains bind the epitope on their specific antigens. Fab fragments differ from Fab' fragments by the addition of a few residues at the carboxy terminus of the heavy chain $CH_1$ domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa and lambda, based on the amino acid sequences of their variable or constant domains. Depending on the amino acid sequence of the constant domain of their heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA, and IgA2.

"Single-chain Fv" or "scFv" or "sFv" antibody fragments comprise the $V_H$ and $V_L$ domains of antibody, wherein these domains are present in a single polypeptide chain. In some embodiments, the Fv polypeptide further comprises a polypeptide linker between the $V_H$ and $V_L$ domains, which enables the sFv to form the desired structure for antigen-binding.

The term "diabodies" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al, Proc. Natl. Acad. Sci. USA, 90:6444-6448 (1993).

An "isolated" antibody or antigen-binding fragment thereof is one that has been identified and separated and/or recovered from a component of its natural environment. Contaminant components of its natural environment are materials that would interfere with diagnostic or therapeutic uses for the antibody, and may include enzymes, hormones, and other proteinaceous or nonproteinaceous solutes. In some embodiments, the antibody will be purified (1) to greater than 95% by weight of antibody as determined by the Lowry method, for example, more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or silver stain. Isolated antibody includes the antibody in situ within recombinant cells since at least one component of the antibody's natural environment will not be present. Ordinarily, however, isolated antibody will be prepared by at least one purification step.

An antibody or antigen-binding fragment thereof that "specifically binds to" or is "specific for" a particular polypeptide or an epitope on a particular polypeptide is one that binds to that particular polypeptide or epitope on a particular polypeptide without substantially binding to any other polypeptide or polypeptide epitope. In some embodiments, the antibody of the present disclosure specifically binds to an antigen, e.g., an HIV-1 gp120 polypeptide, with dissociation constant $K_d$ equal to or lower than 100 nM, optionally lower than 10 nM, optionally lower than 1 nM, optionally lower than 0.5 nM, optionally lower than 0.1 nM, optionally lower than 0.01 nM, or optionally lower than 0.005 nM, in the form of monoclonal antibody, scFv, Fab, or other form of antibody measured at a temperature of about 4° C., 25° C., 37° C., or 42° C. Affinities of antibodies can be readily determined using conventional techniques, for example, those described by Scatchard et al. (Ann. N. Y. Acad. Sci. USA 51: 660 (1949), ELISA assays, biolayer interferometry (BLI) assays, and surface plasmon resonance (SPR) assays). Binding properties of an antibody to antigens, cells or tissues thereof may generally be determined and assessed using immunodetection methods including, for example, immunofluorescence-based assays, such as immuno-histochemistry (IHC) and/or fluorescence-activated cell sorting (FACS).

As used herein, an antibody that "internalizes" is one that is taken up by {i.e., enters) the cell upon binding to an antigen on a mammalian cell {e.g., a cell surface polypeptide or receptor). The internalizing antibody will of course include antibody fragments, human or chimeric antibody, and antibody conjugates. For certain therapeutic applications, internalization in vivo is contemplated. The number of antibody molecules internalized will be sufficient or adequate to kill a cell or inhibit its growth, especially an infected cell. Depending on the potency of the antibody or antibody conjugate, in some instances, the uptake of a single antibody molecule into the cell is sufficient to kill the target cell to which the antibody binds. For example, certain toxins are highly potent in killing such that internalization of one molecule of the toxin conjugated to the antibody is sufficient to kill the infected cell.

The term "antagonist" antibody is used in the broadest sense, and includes an antibody that partially or fully blocks, inhibits, or neutralizes a biological activity of an epitope, polypeptide, or cell that it specifically binds. Methods for identifying antagonist antibodies may comprise contacting a polypeptide or cell specifically bound by a candidate antagonist antibody with the candidate antagonist antibody and measuring a detectable change in one or more biological activities normally associated with the polypeptide or cell.

An "antibody that inhibits the growth of infected cells" or a "growth inhibitory" antibody is one that binds to and results in measurable growth inhibition of infected cells expressing or capable of expressing an HIV1 epitope bound by an antibody. Preferred growth inhibitory antibodies inhibit growth of infected cells by greater than 20%, preferably from about 20% to about 50%, and even more preferably, by greater than 50% (e.g., from about 50% to about 100%) as compared to the appropriate control, the control typically being infected cells not treated with the antibody being tested. Growth inhibition can be measured at an antibody concentration of about 0.1 to about 30 µg/ml or about 0.5 nM to about 200 nM in cell culture, where the growth inhibition is determined 1-10 days after exposure of the infected cells to the antibody. Growth inhibition of infected cells in vivo can be determined in various ways known in the art. The antibody is growth inhibitory in vivo if administration of the antibody at about 1 µg/kg to about 100 mg/kg body weight results in reduction the percent of infected cells or total number of infected cells within about 5 days to 3 months from the first administration of the antibody, preferably within about 5 to 30 days.

An antibody that "induces apoptosis" is one which induces programmed cell death as determined by binding of annexin V, fragmentation of DNA, cell shrinkage, dilation of endoplasmic reticulum, cell fragmentation, and/or formation of membrane vesicles (called apoptotic bodies). Preferably the cell is an infected cell. Various methods are available for evaluating the cellular events associated with apoptosis. For example, phosphatidyl serine (PS) translocation can be measured by annexin binding; DNA fragmentation can be evaluated through DNA laddering; and nuclear/chromatin condensation along with DNA fragmentation can be evaluated by any increase in hypodiploid cells. Preferably, the antibody that induces apoptosis is one that results in about 2 to 50 fold, preferably about 5 to 50 fold, and most preferably about 10 to 50 fold, induction of annexin binding relative to untreated cell in an annexin binding assay.

Antibody "effector functions" refer to those biological activities attributable to the Fc region (a native sequence Fc region or amino acid sequence variant Fc region) of an antibody, and vary with the antibody isotype. Examples of antibody effector functions include: Clq binding and complement dependent cytotoxicity; Fc receptor binding; antibody-dependent cell-mediated cytotoxicity (ADCC); phagocytosis (e.g., antibody-dependent cell-mediated phagocytosis (ADCP)); down regulation of cell surface receptors (e.g., B cell receptor); and B cell activation.

"Antibody-dependent cell-mediated cytotoxicity" or "ADCC" refers to a form of cytotoxicity in which secreted or exogenously administered Ig bound to Fc receptors (FcRs) present on certain cytotoxic cells (e.g., Natural Killer (NK) cells, neutrophils, and macrophages) enable these cytotoxic effector cells to bind specifically to an antigen-bearing target cell and subsequently kill the target cell with cytotoxins. The antibodies "arm" the cytotoxic cells and are required for such killing. The primary cells for mediating ADCC, NK cells, express FcγRIII only, whereas monocytes express FcγRI, FcγRII and FcγRIII FcR expression on hematopoietic cells is summarized in Table 4 on page 464 of Ravetch and Kinet, Annu. Rev. Immunol 9:457-92 (1991). To assess ADCC activity of a molecule of interest, an in vitro ADCC assay, such as that described in U.S. Pat. No. 5,500,362 or 5,821,337 may be performed. Useful effector cells for such assays include peripheral blood mononuclear cells (PBMC) and Natural Killer (NK) cells. Alternatively, or additionally, ADCC activity of the antibody or antigen-binding fragment thereof may be assessed in vivo, e.g., in an animal model such as that disclosed in Clynes et al., Proc. Natl. Acad. Sci. (USA) 95:652-656 (1998).

"Fc receptor" or "FcR" describes a receptor that binds to the Fc region of an antibody. In certain embodiments, the FcR is a native sequence human FcR. Moreover, a preferred FcR is one that binds an IgG antibody (a gamma receptor) and includes receptors of the FcγRI, FcγRII, and FcγRIII subclasses, including allelic variants and alternatively spliced forms of these receptors. FCγRII receptors include FcγRIIA (an "activating receptor") and FcγRIIB (an "inhibiting receptor"), which have similar amino acid sequences that differ primarily in the cytoplasmic domains thereof, and FcγRIIC, which includes the FcγRIIB extracellular domain fused to an activating cytoplasmic region. Activating receptor FcγRIIA contains an immunoreceptor tyrosine-based activation motif (ITAM) in its cytoplasmic domain. Inhibiting receptor FcγRIIB contains an immunoreceptor tyrosine-based inhibition motif (ITIM) in its cytoplasmic domain (see review M. in Daeron, Annu. Rev. Immunol. 15:203-234 (1997)). FcRs are reviewed in Ravetch and Kinet, Annu. Rev. Immunol 9:457-92 (1991); Capel et al, Immunomethods 4:25-34 (1994); and de Haas et al, J. Lab. Clin. Med. 126:330-41 (1995). Other FcRs, including those to be identified in the future, are encompassed by the term "FcR" herein. The term also includes the neonatal receptor, FcRn, which is responsible for the transfer of maternal IgGs to the fetus (Guyer et al, J. Immunol. 117:587 (1976) and Kim et al, J. Immunol. 24:249 (1994)), and which plays a role in salvaging IgG from lysosomal degradation by FcRn dependent recycling following endocytosis. FcRn binding following pinocytosis in endothelial cells has been shown to be important for sustaining the prolonged pharmacokinetic half-life of antibodies. Assessment of pH dependent human FcRn binding of antibodies in vitro may be performed to provide a prediction of potential for favorable clinical pharmacokinetics (Datta-Mannan and Wroblewski, Drug Metab. Dispos. 42:1867-1872 (2014)).

"Human effector cells" are leukocytes that express one or more FcRs and perform effector functions. Preferably, the cells express at least FcγRIII and perform ADCC effector function. Examples of human leukocytes that mediate ADCC include PBMC, NK cells, monocytes, cytotoxic T cells and neutrophils; with PBMCs and NK cells being preferred. The effector cells may be isolated from a native source, e.g., from blood.

"Complement dependent cytotoxicity" or "CDC" refers to the lysis of a target cell in the presence of complement. Activation of the classical complement pathway is initiated by the binding of the first component of the complement system (Clq) to antibodies (of the appropriate subclass) that are bound to their cognate antigen. To assess complement activation, a CDC assay, e.g., as described in Gazzano-Santoro et al, J. Immunol. Methods 202: 163 (1996), may be performed.

A "mammal" for purposes of treating an infection, refers to any mammal, including humans, domestic and farm animals, research animals, such as mice, rats, and primates, and zoo, sports, or pet animals, such as dogs, cats, cattle, horses, sheep, pigs, goats, rabbits, etc. In particular embodiments, the mammal is human.

A "neutralizing antibody" is one that can neutralize the ability of that pathogen to initiate and/or perpetuate an infection in a host and/or in target cells in vitro. The invention provides neutralizing monoclonal human antibodies and antigen-binding fragments thereof, wherein the antibody recognizes an antigen from HIV, e.g., a gp120 polypeptide. In certain embodiments, a "neutralizing antibody" may inhibit the entry of HIV-1 virus, e.g., SF162 and/or JR-CSF, with a neutralization index>1.5 or >2.0 (Kostrikis L G et al./Virol. 1996; 70(1): 445-458). By "broadly neutralizing antibodies" are meant antibodies that neutralize more than one HIV-1 virus species (from diverse clades and different strains within a clade) in a neutralization assay. A broad neutralizing antibody may neutralize at least 2, 3, 4, 5, 6, 7, 8, 9 or more different strains of HIV-1, the strains belonging to the same or different clades. In particular embodiments, a broad neutralizing antibody may neutralize multiple HIV-1 species belonging to at least 2, 3, 4, 5, or 6 different clades. In certain embodiments, the inhibitory concentration of the monoclonal antibody may be less than about 0.0001 µg/ml, less than about 0.001 µg/ml, less than about 0.01 µg/ml, less than about 0.1 µg/ml, less than about 0.5 µg/ml, less than about 1.0 µg/ml, less than about 5 µg/ml, less than about 10 µg/ml, less than about 25 µg/ml, less than about 50 µg/ml, or less than about 100 µg/ml to neutralize about 50% of the input virus in the neutralization assay.

HIV viruses are divided into specific groups, M, N, O and P, of which M is the "major" group and responsible for majority of HIV/AIDS globally. Based on their genetic sequence, Group M is further subdivided into subtypes (also called clades) with prevalence in distinct geographical locations.

A Group M "subtype" or "clade" is a subtype of HIV-1 group M defined by genetic sequence data. Examples of Group M subtypes include Subtypes A-K. Some of the subtypes are known to be more virulent or are resistant to different medications. There are also "circulating recombinant forms" or CRFs derived from recombination between viruses of different subtypes, which are each given a number. CRF12_BF, for example, is a recombination between subtypes B and F. Subtype A is common in West Africa. Subtype B is the dominant form in Europe, the Americas, Japan, Thailand, and Australia. Subtype C is the dominant form in Southern Africa, Eastern Africa, India, Nepal, and parts of China. Subtype D is generally only seen in Eastern and central Africa. Subtype E has never been identified as a nonrecombinant, only recombined with subtype A as CRF01_AE. Subtype F has been found in central Africa, South America and Eastern Europe. Subtype G (and the CRF02_AG) have been found in Africa and central Europe. Subtype H is limited to central Africa. Subtype I was originally used to describe a strain that is now accounted for as CRF04_cpx, with the cpx for a "complex" recombination of several subtypes. Subtype J is primarily found in North, Central and West Africa, and the Caribbean Subtype K is limited to the Democratic Republic of Congo and Cameroon. These subtypes are sometimes further split into sub-subtypes such as A1 and A2 or F1 and F2. In 2015, the strain CRF19, a recombinant of subtype A, subtype D and subtype G, with a subtype D protease was found to be strongly associated with rapid progression to AIDS in Cuba.

"HIV tropism" refers to the specificity of an HIV virus for a particular host cell, determined in part by the interaction of viral surface structures with receptors present on the surface of the host cell. HIV tropism of a patient's virus may be measured by the Trofile assay.

HIV can infect a variety of cells such as CD4+ helper T cells and macrophages that express the CD4 molecule on their surface. HIV-1 entry to macrophages and T helper cells is mediated not only through interaction of the virion envelope glycoprotein, (e.g., gp120) with the CD4 molecule on the target cells but also with its chemokine coreceptors. Macrophage (M-tropic) strains of HIV-1, or non-syncitia-inducing strains (NSI) use the beta-chemokine receptor CCR5 for entry and are thus able to replicate in macrophages and CD4+ T-cells. These strains are called R5 viruses. This CCR5 coreceptor is used by almost all primary HIV-1 isolates regardless of viral genetic subtype. T-tropic isolates, or syncitia-inducing (SI) strains replicate in primary CD4+ T-cells as well as in macrophages and use the alpha-chemokine receptor, CSCR4, for entry. These strains are called X4 viruses. Viruses that use only the CCR5 receptor are termed R5, those that only use CXCR4 are termed X4, and those that use both, X4R5 or dual/mixed-tropism. However, the use of a coreceptor alone does not explain viral tropism, as not all R5 viruses are able to use CCR5 on macrophages for a productive infection.

The present invention also relates to "non-neutralizing antibodies," which in certain embodiments are antibodies that bind to one or more strains of virus but do not neutralize the virus. However, in terms of Fc-mediated killing, the non-neutralizing antibody could still eliminate cells expressing viral antigens that are bound but not neutralized by the antibody. Thus, in certain embodiments, an antibody of the invention can bind a viral antigen and eliminate virally infected cells without neutralizing the virus.

The term "nucleic acid molecule" refers to a polymeric form of nucleotides and includes both sense and anti-sense strands of RNA, cDNA, genomic DNA, and synthetic forms and mixed polymers of the above. In particular embodiments, a nucleotide refers to a ribonucleotide, deoxynucleotide or a modified form of either type of nucleotide, and combinations thereof. The terms also include, but is not limited to, single- and double-stranded forms of DNA. In addition, a polynucleotide, e.g., a cDNA or mRNA, may include either or both naturally occurring and modified nucleotides linked together by naturally occurring and/or non-naturally occurring nucleotide linkages. The nucleic acid molecules may be modified chemically or biochemically or may contain non-natural or derivatized nucleotide bases, as will be readily appreciated by those of skill in the art. Such modifications include, for example, labels, methylation, substitution of one or more of the naturally occurring nucleotides with an analogue, internucleotide modifications such as uncharged linkages (e.g., methyl phosphonates, phosphotriesters, phosphoramidates, carbamates, etc.), charged linkages (e.g., phosphorothioates, phosphorodithioates, etc.), pendent moieties (e.g., polypeptides), intercalators (e.g., acridine, psoralen, etc.), chelators, alkylators, and modified linkages (e.g., alpha anomeric nucleic acids, etc.). The above term is also intended to include any topological conformation, including single-stranded, double-stranded, partially duplexed, triplex, hairpinned, circular and padlocked conformations. A reference to a nucleic acid sequence encompasses its complement unless otherwise specified. Thus, a reference to a nucleic acid molecule having a particular sequence should be understood to encompass its complementary strand, with its complementary sequence. The term also includes codon-optimized nucleic acids.

The term "operably linked" refers to two or more nucleic acid sequence elements that are usually physically linked and are in a functional relationship with each other. For instance, a promoter is operably linked to a coding sequence if the promoter is able to initiate or regulate the transcription or expression of a coding sequence, in which case, the coding sequence should be understood as being "under the control of" the promoter.

A "substitution," as used herein, denotes the replacement of one or more amino acids or nucleotides by different amino acids or nucleotides, respectively.

An "isolated" nucleic acid refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

"Isolated nucleic acid encoding an antibody or fragment thereof" refers to one or more nucleic acid molecules encoding antibody heavy and light chains (or fragments thereof), including such nucleic acid molecule(s) in a single vector or separate vectors, and such nucleic acid molecule(s) present at one or more locations in a host cell.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors."

The terms "host cell," "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein.

A polynucleotide "variant," as the term is used herein, is a polynucleotide that typically differs from a polynucleotide specifically disclosed herein in one or more substitutions, deletions, additions and/or insertions. Such variants may be naturally occurring or may be synthetically generated, for example, by modifying one or more of the polynucleotide sequences of the invention and evaluating one or more biological activities of the encoded polypeptide as described herein and/or using any of a number of techniques well known in the art.

A polypeptide "variant," as the term is used herein, is a polypeptide that typically differs from a polypeptide specifically disclosed herein in one or more substitutions, deletions, additions and/or insertions. Such variants may be naturally occurring or may be synthetically generated, for example, by modifying one or more of the above polypeptide sequences of the invention and evaluating one or more biological activities of the polypeptide as described herein and/or using any of a number of techniques well known in the art.

The term "variant" may also refer to any naturally occurring or engineered molecule comprising one or more nucleotide or amino acid mutations. In one embodiment, the molecule is an antibody. For example, somatic variants may encompass all related naturally occurring antibodies that are part of or derived from the same B-cell lineage. Engineered variants may encompass all single mutations or combinatorial mutations made to an antibody.

The terms "PGT121," "PGT-121," "PGT121 WT," "PGT-121 WT," "PGT121-WT," "PGT121.WT," "PGT121.1," "PGT121 LO6," "PGT121 LO6," "PGT121 LO6 WT," "PGT121 LO6 WT" or the like are used interchangeably herein and refer to an antibody comprising a heavy chain and a light chain, wherein the heavy chain having an amino acid sequence as set forth in SEQ ID NO: 190, and the light chain having an amino acid sequence as set forth in SEQ ID NO: 276

Modifications may be made in the structure of the polynucleotides and polypeptides of the present invention and still obtain a functional molecule that encodes a variant or derivative polypeptide with desirable characteristics. When it is desired to alter the amino acid sequence of a polypeptide to create an equivalent, or even an improved, variant or portion of a polypeptide of the invention, one skilled in the art will typically change one or more of the codons of the encoding DNA sequence.

For example, certain amino acids may be substituted for other amino acids in a protein structure without appreciable loss of its ability to bind other polypeptides (e.g., antigens) or cells. Since it is the binding capacity and nature of a protein that defines that protein's biological functional activity, certain amino acid sequence substitutions can be made in a protein sequence, and, of course, its underlying DNA coding sequence, and nevertheless obtain a protein with like properties. It is thus contemplated that various changes may be made in the polypeptide sequences of the disclosed antibodies and antigen-binding fragments thereof, or corresponding DNA sequences that encode said polypeptides without appreciable loss of their biological utility or activity.

In many instances, a polypeptide variant will contain one or more conservative substitutions. A "conservative substitution" is one in which an amino acid is substituted for another amino acid that has similar properties, such that one skilled in the art of peptide chemistry would expect the secondary structure and hydropathic nature of the polypeptide to be substantially unchanged.

When comparing polynucleotide and polypeptide sequences, two sequences are said to be "identical" if the sequence of nucleotides or amino acids in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345-358; Hein J. (1990) Unified Approach to Alignment and Phylogenes pp. 626-645 Methods in Enzymology vol. 183, Academic Press, Inc., San Diego, Calif.; Higgins, D. G. and Sharp, P. M. (1989) CABIOS 5: 151-153; Myers, E. W. and Muller W. (1988) CABIOS 4:11-17; Robinson, E. D. (1971) Comb. Theor 77: 105; Santou, N. Nes, M. (1987) Mol. Biol. Evol. 4:406-425; Sneath, P. H. A. and Sokal, R. R. (1973) Numerical Taxonomy—the Principles and Practice of Numerical Taxonomy, Freeman Press, San Francisco, Calif.; Wilbur, W. J. and Lipman, D. J. (1983) Proc. Natl. Acad., Sci. USA 80:726-730.

Alternatively, optimal alignment of sequences for comparison may be conducted by the local identity algorithm of Smith and Waterman (1981) Add. APL. Math 2:482, by the identity alignment algorithm of Needleman and Wunsch (1970) J. Mol. Biol. 48:443, by the search for similarity methods of Pearson and Lipman (1988) Proc. Natl. Acad. Sci. USA 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One example of algorithms that are suitable for determining percent sequence identity and sequence similarity are the BLAST and BLAST 2.0 algorithms, which are described in Altschul et al. (1977) Nucl. Acids Res. 25:3389-3402 and Altschul et al. (1990) J. Mol. Biol. 215:403-410, respectively. BLAST and BLAST 2.0 can be used, for example with the parameters described herein, to determine percent sequence identity for the polynucleotides and polypeptides of the invention. Software for performing BLAST analyses is publicly available through the National Center for Biotechnology Information.

In one illustrative example, cumulative scores can be calculated using, for nucleotide sequences, the parameters M (reward score for a pair of matching residues; always >0) and N (penalty score for mismatching residues; always <0). Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a word length (W) of 11, and expectation (E) of 10, and the BLOSUM62 scoring matrix (see Henikoff and Henikoff (1989) Proc. Natl. Acad. Sci. USA 89: 10915) alignments, (B) of 50, expectation (E) of 10, M=5, N=-4 and a comparison of both strands.

For amino acid sequences, a scoring matrix can be used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment.

In one approach, the "percentage of sequence identity" is determined by comparing two optimally aligned sequences over a window of comparison of at least 20 positions, wherein the portion of the polynucleotide or polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases or amino acid residues occur in both sequences to yield the number of matched positions, dividing the number of matched positions by the total number of positions in the reference sequence (i.e., the window size) and multiplying the results by 100 to yield the percentage of sequence identity.

"Homology" refers to the percentage of residues in the polynucleotide or polypeptide sequence variant that are identical to the non-variant sequence after aligning the sequences and introducing gaps, if necessary, to achieve the maximum percent homology.

"Developability" refers to the intrinsic chemical and biophysical properties of an antibody that make it suitable for commercial manufacturing and therapeutic use. These properties may include thermal stability (e.g. melting temperature), low pH stability (e.g. during viral inactivation procedures required during GMP production), solubility, viscosity, product homogeneity and chemical stability (e.g. oxidation, deamidation, isomerization, cleavage, glycosylation, glycation, hydroxylation).

"Binding affinity" may refer to a binding dissociate constant (Kd) or an apparent affinity (e.g., EC50) value.

"Percent aggregation" may refer to a percent loss of soluble protein monomer as determined by SEC. Thus, a percent change in monomer content with a negative value would indicate a loss of monomer and an increase in aggregation, while a percent change in monomer content with a positive value would indicate an increase in monomer and a corresponding decrease in aggregation.

Antibodies and Antigen-Binding Fragments Thereof, Nucleic Acids, Vectors and Host Cells The present invention includes novel antibodies and antigen-binding fragments thereof. In certain embodiments, these antibodies and antigen-binding fragments thereof bind to and neutralize HIV-1, e.g., cell-free HIV-1 virus. In certain embodiments, these antibodies and antigen-binding fragments thereof bind to HIV-1 antigens expressed on a cell surface and eliminate or kill the cell. In various embodiments, the antibodies activate effector cells, e.g., T cells expressing FcγRIIA. In certain embodiments, the Fc domain of the antibodies binds FCγRs expressed on innate immune cells. In particular embodiments, they induce natural killer (NK) cell-mediated antibody-dependent cell killing of HIV-1 infected cells, e.g., via antibody dependent cellular cytotoxicity (ADCC). In particular embodiments, they induce monocyte- and peripheral blood mononuclear cell (PBMC)-mediated antibody-dependent cell killing, e.g., via antibody-dependent cellular phagocytosis (ADCP) and/or granzyme- and perforin-mediated cytotoxicity or ADCC.

In particular embodiments, antibodies and antigen-binding fragments thereof of the present invention are related to the antibody previously described as PGT-121 LO6 in PCT Application Publication No. WO2012/030904. In certain embodiments, the antibodies and antigen-binding fragments thereof comprise the six CDRs present in the PGT-121 LO6 antibody, as defined by one or more of the Kabat, IMGT, or Chothia antibody numbering schemes. In certain embodiments, the antibodies and antigen-binding fragments thereof comprise at least one, at least two, at least three, at least four, or at least five of the CDRs present in the PGT-121 LO6 antibody. The PGT-121 LO6 CDRs are provided in Table 1. In particular embodiments, the present invention includes a light chain (or antigen-binding fragment thereof) or a heavy chain (or antigen-binding fragment thereof) of an antibody of the present invention. In particular embodiments, an antibody of the present invention or antigen-binding fragment thereof is not the PGT-121 LO6 antibody or an antigen-binding fragment thereof.

In particular embodiments, antibodies and antigen-binding fragments thereof of the present invention are related to any of the variants or derivatives of PGT-121 LO6 described herein, e.g., having sequences shown in Table 1. In certain embodiments, the antibodies and antigen-binding fragments thereof comprise six CDRs present in any of the antibodies shown in Table 1, as defined by one or more of the Kabat, IMGT, or Chothia antibody numbering schemes. In certain embodiments, the antibodies and antigen-binding fragments thereof comprise at least one, at least two, at least three, at least four, or at least five of the CDRs present in any of the antibodies provided in Table 1.

In particular embodiments, the antibodies and antigen-binding fragments thereof comprise a CDR, heavy chain and/or a light chain comprising one or more amino acid modification, e.g., insertion, deletion or substitution, as compared to PGT-121 LO6. In various embodiments, the one or more amino acid modification imparts one or more improved properties, (e.g., therapeutic properties) to the antibody or antigen-binding fragment thereof as compared to the PGT-121 LO6 antibody. Without limitation, particular embodiments of the one or more amino acid modifications provide the antibody or antigen-binding fragment thereof with superior pharmacokinetic properties, increased serum stability (e.g., increased serum half-life), increased $C_{max}$, increased binding affinity, increased effector function, increased neutralization of HIV-1, reduced immunogenicity, and/or increased efficiency or ease of manufacture, as compared to PGT-121 LO6. In various embodiments, the one or more amino acid modifications impart improved developability (e.g., increased Tm, increased stability during low pH viral inactivation procedures, and/or removal of heterogeneous N-linked glycans). In various embodiments, the one or more amino acid modifications impart reduced immunogenicity (e.g., reduction in ex vivo T-cell activation donor response rate) through removal (e.g., through site directed mutagenesis) of experimentally identified T-cell epitopes. Without limitation, particular embodiments of the one or more amino acid modifications provide the antibody or antigen-binding fragment thereof with superior pharmacokinetic properties, increased serum stability (e.g., increased serum half-life), increased $C_{max}$, increased binding affinity, increased effector function, increased neutralization of HIV-1, reduced immunogenicity, and/or increased efficiency or ease of manufacture, as compared to PGT-121 LO6. In various embodiments the mutations introduced to enhance any of the properties listed above (e.g., reduced immunogenicity, enhanced therapeutic properties and/or antigen binding, or enhanced developability properties) may lie in the CDR regions, the framework regions or in framework regions predicted to interact directly with antigen (e.g., framework regions that are functionally equivalent to CDRs).

Crystal structure and experimental analysis of an antibody highly related to the PGT-121 LO6 antibody (i.e., PGT-122) revealed that it utilizes amino acid residues outside of the CDRs to bind antigen (together with the CDRs). For example, this antibody appears to have additional regions in the framework region that contact antigens (see, e.g., Experimental Validation for PGT121 and related antibodies: Sok et al. 2013. PLOS Pathogens 9, e1003754). High resolution structures of PGT122 bound to the Env viral antigen have been determined (see, e.g., Julien, J. P. et al, 2013, Science 342, 14777-14783 and Pancera, M. et al., 2014, Nature 514, 455-461). The structure of PGT121 is described in Julien J P et al. 2013, PLOS Pathogens 9, e1003342 and Mouquet H et al. 2012, PNAS 109, E3268-E3277. The structure of PGT122 is described in Julien J P et al. 2013. PLOS Pathogens 9, e1003342. PDB ID 4JY5; and the structure of PGT123 is described in Julien J P et al. 2013, PLOS Pathogens 9, e1003342. The PGT122 and PGT123 antibodies are closely related to the PGT121 antibody, so the PGT122/Env structure, together with knowledge of the PGT121, PGT122 and PGT123 structures, can be used to model the structure of PGT121 bound to Env very accurately and predict with high confidence the residues of PGT121 involved in binding to Env. The predicted PGT121 contact residues based on similarity to PGT122 and the PGT122/Env structure (Kabat numbering) are provided below with framework residues shown in bold:

HC (Kabat #): 33, 56, 58, 99, 100, 100A, 100B, 100C, 100D, 100E, 100G, 100I, 100J, 100K, 100L; and LC (Kabat #): 28, 29, 30, 50, 51, 52, 66, 67, 67A, 67C, 91, 92, 93, 94, 95, 95A, 95B.

In addition, the PGT-121 LO6 antibody has been shown to bind to many different variants of antigen, e.g., different viral strains, which may contact the antibody at unknown amino acid positions in addition to those listed above. Different viral strains have different Env (i.e., antigen) sequences and different glycosylation patterns, and even a single Env sequence can have heterogeneous glycosylation patterns, requiring a broadly binding or neutralizing antibody to recognize Env proteins of different HIV-1 variants or even different glycosylation patterns on the same Env protein. For example, the epitope of PGT121 is comprised of the Env V3 loop, in particular an N-linked glycan at position N332. The V3 loop is the major determinant of cellular tropism and viral clade. Among 117 CCR5-tropic viruses of multiple clades, the presence of a potential N-linked glycosylation (PNG) motif in the viral DNA sequence encoding for the N332 glycan was statistically significantly associated with susceptibility to neutralization by PGT121 amongst viruses of clades B, G, A, AC and AE. Among 50 clade B Env sequences isolated from patients participating in Gilead-sponsored clinical trials, 94% of CCR5-tropic Envs harboring the N332 PNG motif were susceptible to neutralization by PGT121 compared to only 26% of viruses that were not CCR5-tropic, N332 PNG positive (P<0.0001). Thus, genetic determination of Env clade, tropism and presence of the N332 PNG motif is highly predictive of neutralization susceptibility by PGT121 and may be useful as a marker to predict viral susceptibility to neutralization by PGT121 and its derivatives.

Nevertheless, given the diversity in the amino acid sequences of the different antigen variants, it may be difficult to predict which amino acid residues in the antibody variable regions are required for binding to the various antigen variants, and may also, therefore, be difficult or impossible to predict a priori exactly which amino acid residues of the antibody could be altered to impart improved properties to the antibody, e.g., reduced glycosylation, reduced immunogenicity, reduced isomerization, enhanced effector function, enhanced neutralizing activity, or enhanced recombinant production. The present invention relates to the identification of particular amino acid modifications, and combinations thereof, that effectively enhance the therapeutic properties of the claimed antibodies and antigen-binding fragments thereof, without substantially impacting their ability to bind multiple antigen variants and, in certain embodiments, their related broadly neutralizing properties. In certain embodiments, antibodies of the present invention are neutralizing antibodies, e.g., broadly neutralizing antibodies, while in other embodiments, antibodies of the present invention are non-neutralizing antibodies capable of eliminating cells expressing viral antigens that are bound but not neutralized by the antibodies.

In particular embodiments, an antibody or antigen-binding fragment of the present invention has better serum pharmacokinetics (e.g., increased serum half-life) as compared to the PGT-121 LO6 antibody, e.g., following administration to a mammal. In other embodiments, an antibody or antigen-binding fragment of the present invention has comparable serum pharmacokinetics (e.g., increased serum half-life) as compared to the PGT-121 LO6 antibody. In particular embodiments of the current invention, the serum pharmacokinetics (e.g., area under concentration-time curve (AUC), clearance (CL), volume (V), half-life ($t_{1/2}$), maximum concentration ($C_{max}$), or minimum concentration (Crain)) are determined from the measured serum levels of the antibody at various time points following administration to test subjects. Assays to measure serum antibody levels and methods to calculate the resulting pharmacokinetics are known in the art. Amounts of the antibody present in the serum may be determined by standard techniques, such as LC-MS/MS, ELISA, SPR, BLI, ECL (MSD), alpha-LISA or HTRF, e.g., ELISA using recombinant gp120 protein as described in Example 3 of PCT Application Publication No. WO2012/040904. In certain embodiments the antibody serum concentrations may be determined by capturing using recombinant BAL gp120 or SHIV gp140 and detected with an anti-human $IgG_1$ conjugate employing electrochemilluminescence (ECL) detection with the Meso Scale Discovery (MSD) platform. Pharmacokinetics can be determined using standard non- or multi-compartmental pharmacokinetic analysis from the resulting antibody serum concentration-time profiles. In certain embodiments, an antibody or antigen-binding fragment of the present invention has unchanged, or improved pharmacokinetics, as compared to the PGT121 LO6 antibody following administration to mammals (e.g., humans, rats or monkeys). Improved pharmacokinetics is defined by either increased exposure (AUC), reduced clearance, and increased half-life, increased $C_{max}$, or increased Crain. In certain embodiments, the pharmacokinetics are improved by at least 0%, 10%, at least 20%, at least 30%, at least 40%, at least 50%, at least 60%, at least 70%, at least 80%, at least 90%, at least 100%, at least 150%, at least 200%, at least 300%, at least 400%, at least 500%, or at least 1000%.

In certain embodiments, an antibody or antigen-binding fragment of the present invention has increased serum stability (e.g., increased serum half-life) as compared to the PGT-121 LO6 antibody, e.g., following administration to a mammal. Assays to measure serum stability or antibody half-life are known in the art. In one embodiments, serum stability or serum half-life may be determined by measuring serum levels of the antibody at various time points following administration to a subject, e.g., a human or test animal. Amounts of the antibody present in the serum may be determined by standard techniques, such as LC-MS/MS, ELISA, SPR, BLI, ECL (MSD), alpha-LISA or HTRF, e.g., ELISA using recombinant gp120 protein as described in WO 2012/040904. In some embodiments, the serum stability or serum half-life may be increased by at least 10%, at least 20%, at least 30%, at least 40%, at least 50%, at least 60%, at least 70%, at least 80%, at least 90%, at least 100%, at least 150%, at least 200%, at least 300%, at least 400%, at least 500%, or at least 1000%. In certain embodiments, the antibodies or antigen-binding fragments thereof of the present invention have a serum half-life of at least 30 min, at least 1 hour, at least 4 hours, at least 8 hours, at least 12 hours, at least 16 hours, at least 24 hours, at least 2 days, at least 3 days, at least 4 days, at least 5 days, at least one week, at least two weeks, at least three weeks, at least four weeks, or at least two months. In some embodiments, the antibodies or antigen-binding fragments thereof of the present invention may have increased serum stability as compared to the PGT-121 LO6 antibody at about 4° C., at about 5° C., at about 10° C., at about 15° C., at about 20° C., at about 25° C., at about 30° C., at about 37° C., or more.

In certain embodiments, an antibody or antigen-binding fragment of the present invention has equal or increased or greater antigen binding affinity as compared to the PGT-121 LO6 antibody, e.g., to at least one strain of HIV. In particular embodiments, the antigen is the complete membrane bound HIV Env trimer expressed on either a cellular surface or viral envelope, the soluble gp140 fragment of Env, the soluble gp120 fragment of Env, or any smaller sub-domain or engineered portion of Env containing all necessary epitope determining residues and structures needed for PGT121 binding, from any of the HIV-1 strains described herein. Binding affinity may be readily determined using an assay known and available in the art, such as ELISA, SPR, BLI or flow cytometry.

In particular embodiments, apparent binding affinity is determined by standard techniques, such as ELISA, e.g., using recombinant gp120 or gp140 protein as described in Example 3 of PCT Application Publication No. WO2012/030904, or as described herein. In certain embodiments, the binding affinity to at least one HIV strain is increased, e.g., by at least 0%, 10%, at least 20%, at least 30%, at least 40%, at least 50%, at least 60%, at least 70%, at least 80%, at least 90%, at least 100%, at least 150%, at least 200%, at least 300%, at least 400%, at least 500%, at least 1000%, at least 1500%, at least 2000%, at least 2500%, at least 3000%, at least 5000%, or at least 10,000%. In certain embodiments, the one or more strain includes BaL, TRO, SHIV, SF162 P3, pRHPA4259, qh0692, 6535, pCAAN5342, pWITO4160, AC10.0, US92HT593, or U92US657. In some embodiments, the one or more strain includes BaL, TRO, SHIV SF162 P3, pRHPA4259, qh0692, 6535, pCAAN5342, pWITO4160, AC10.0, US92HT593, or U92US657. In particular embodiments, antibodies and fragments thereof of the present invention bind to HIV gp120 BaL with an EC50 of <20.0 nM, <10 nM, or <1 nM as determined in direct ELISA assay as described herein. In certain embodiments, antibodies and fragments thereof of the present invention bind to HIV gp120 BaL, gp140 BaL, gp140 SHIV SF162P3, or gp120 TRO with ELISA EC50 values lower, e.g., 2-fold, 1.6-fold, 1.4-fold, 1.2-fold, 1-fold, 0.8-fold, 0.6-fold lower than PGT121 LO6. In certain embodiments, antibodies and fragments thereof of the present invention bind to HIV gp120 BaL, gp120 pRHPA4259, gp120 qh0692, gp120 6535, gp120 pCAAN5342, gp120 pWITO4160, or gp120 AC10.0 with ELISA EC50 values 3-fold, 2.5-fold, 2-fold, 1.5-fold, 1-fold, or 0.5-fold lower than for PGT121 LO6.

In other embodiments, binding affinity is determined by FACS using human cell lines expressing recombinant HIV Env. The one or more strain includes BaL, US657, HT593 or SHIV SF162 P3. In particular embodiments, the binding affinity to at least one strain is increased, e.g., by at least 10%, at least 20%, at least 30%, at least 40%, at least 50%, at least 60%, at least 70%, at least 80%, at least 90%, at least 100%, at least 150%, at least 200%, at least 300%, at least 400%, at least 500%, at least 1000%, at least 1500%, at least 2000%, at least 2500%, at least 3000%, at least 5000%, or at least 10,000%. In certain embodiments, antibodies and fragments thereof of the present invention bind to an HIV Env of at least one strain with an IC50 of <1.0 nM or <0.8 nM as determined by ELISA. In certain embodiments, antibodies and fragments thereof of the present invention bind to an HIV Env of at least one strain with an IC50 as determined by ELISA of about 0.1 uM to about 10 nM or about 0.1 uM to about 20 nM. In certain embodiments, antibodies and fragments thereof of the present invention bind to an HIV gp120 (BaL) of at least one strain with an EC50 of <20 nM, <10 nM, <5 nM, <2 nM, <1 nM, <0.5 nM, <0.2 nM or <0.1 nM. In particular embodiments, the at least one strain comprises two or more, three or more, four or more, or five or more strains, e.g., any of those described herein.

In particular embodiments, an antibody or antigen binding fragment of the present invention has increased binding affinity to FcγR as compared to the PGT-121 LO6 antibody. Binding affinity may be readily determined using an assay known and available in the art, such as ELISA, SPR or BLI. In particular embodiments, binding affinity is determined by standard techniques, such as ELISA, e.g., as described herein. In particular embodiments, the binding affinity is increased, e.g., by at least 10%, at least 20%, at least 30%, at least 40%, at least 50%, at least 60%, at least 70%, at least 80%, at least 90%, at least 100%, at least 150%, at least 200%, at least 300%, at least 400%, at least 500%, at least 1000%, at least 20-fold, at least 30-fold, at least 50-fold, at least 100-fold, or at least 1000-fold. In certain embodiments, antibodies or fragments thereof of the present invention bind to any of human FcγRI, human FcγRIIA-167H, human FcγRIIA-167R, human FcγRIIB, human FcγRIIIA-176V, human FcγRIII-176F, human FcγRIIIB-NA1, human FcγRIIIB-NA2, human FcRn at pH 7.0, or human FcRn at pH 6.0 with any of the following EC50s as determined by ELISA: <0.1 nM, <0.2 nM, <0.3 nM, <0.5 nM, <1.0 nM, <1.5 nM, <2.0 nM, <2.5 nM, <3.0 nM, <3.5 nM, <5 nM, <10 nM, <20 nM, <25 nM, <30 nM, >40 nM, <50 nM, <100 nM, <200 nM, <250 nM, <500 nM, <1 μM, <2 μM, <5 μM, or greater than or equal to 10 μM. In particular embodiments, antibodies or fragments thereof of the present invention bind to human FcgRI with an EC50 between 0.1 and 1 μM. In particular embodiments, antibodies or fragments thereof of the present invention bind to human FcgRIIIA-176F with an EC50 between 0.1 and 10 nM. In particular embodiments, antibodies or fragments thereof of the present invention bind to human FcgRIIIA-176V with an EC50 between 1 and 0.1 nM. In particular embodiments, antibodies or fragments thereof of the present invention bind to human FcgRIIA-167H with an EC50 between 100 and 1 nM. In particular embodiments, antibodies or fragments thereof of the present invention bind to human FcgRIIA-167R with an EC50 between 50 and 1 nM. In particular embodiments, antibodies or fragments thereof of the present invention bind to human FcgRIIB with an EC50 between 1 μM and 10 nM. In particular embodiments, antibodies or fragments thereof of the present invention bind to human FcgRIIIB-NA1 with an EC50 between 1 nM and 50 nM. In particular embodiments, antibodies or fragments thereof of the present invention bind to human FcgRIIIB-NA2 with an EC50 between 1 nM and 50 nM. In certain embodiments, antibodies or fragments thereof of the present invention bind to human FcgRI with an EC50 between 0.5-fold and 1.5 fold of the EC50 determined for PGT121 LO6. In particular embodiments, antibodies or fragments thereof of the present invention bind to human FcγRI with an EC50 that is unchanged compared to PGT121 LO6. In certain embodiments, antibodies or fragments thereof of the present invention bind to human FcgRIIIA-176F with an EC50 0.5-fold, 2-fold, 4-fold, 10-fold, 15-fold, 20-fold, 50-fold, or 100-fold lower than that determined for PGT121 LO6. In particular embodiments, antibodies or fragments thereof of the present invention bind to human FcgRIIIA-176F with an ELISA EC50 that is between 10- and 20-fold lower than PGT121 LO6.

In particular embodiments, an antibody or antigen binding fragment of the present invention has increased binding affinity to FcRn at pH 6.0 when compared to the PGT-121 LO6 antibody. In certain embodiments, an antibody or antigen binding fragment of the present invention has increased binding affinity to FcRn at pH 6.0 and decreased or similar binding at pH 7.4 or pH 7.0 when compared to the PGT-121 LO6 antibody. Binding affinity may be readily determined using an assay known and available in the art, such as ELISA, SPR or BLI. In particular embodiments, binding affinity is determined by standard techniques, such as ELISA, e.g., as described herein. In particular embodiments, the binding affinity to FcRn is increased, e.g., by at least 10%, at least 20%, at least 30%, at least 40%, at least 50%, at least 60%, at least 70%, at least 80%, at least 90%, at least 100%, at least 150%, at least 200%, at least 300%, at least 400%, at least 500%, at least 1000%, at least 20-fold, at least 30-fold, at least 50-fold, at least 100-fold, or at least 1000-fold. In certain embodiments, antibodies or fragments thereof of the present invention bind to human FcRn pH 6.0: <10 nM, <2.0 nM or <1.0 nM. In certain embodiments, antibodies or fragments thereof of the present invention bind to human FcRn at pH 7.0 with any of the following EC50s as determined by ELISA: <0.1 nM, <0.2 nM, <0.3 nM, <0.5 nM, <1.0 nM, <1.5 nM, <2.0 nM, <2.5 nM, <3.0 nM, <3.5 nM, <5 nM, <10 nM, <20 nM, <25 nM, <30 nM, <40 nM, <50 nM, <100 nM, <200 nM, <250 nM, <500 nM, <1 μM, <2 μM, <5 μM, <10 μM, <50 μM, <100 μM, or greater than or equal to 100 μM.

The manufacturing process for biotherapeutics requires a viral inactivation (VI) procedure, designed as a safety measure to remove any potential viral contaminants that could be present in the cell culture process used to produce the antibody. This VI procedure is typically accomplished by holding the purified antibody solution at a low pH (often at or near a pH of 3.5) for an extended time (often 1-3 hours). Certain antibodies are known to form either soluble or insoluble aggregates during this process (10-20% or greater aggregate content), making them unfit for manufacturing. Thus, the stability of an antibody at low pH (e.g., pH 3.5) is a critical manufacturing attribute, and improvement of low pH stability can enable manufacturing and production of certain antibodies for therapeutic use.

In certain embodiments, an antibody or antigen binding fragment of the present invention has increased stability at low pH as measured by % aggregation, i.e., it shows reduced aggregation when stored at a low pH, e.g., pH 3.5 in various antibody storage and elution buffers when compared to PGT121 LO6. In particular embodiments, it shows less than 80%, less than 50%, less than 10% aggregation when held at pH 3.5 for 1 h. In particular embodiments, it shows less than 10%, less than 5%, less than 2%, or less than 1%, or 0% measurable aggregation when held at pH 3.5 for 1 hour. In particular embodiments it shows an improvement in monomer content (ie a reduction in aggregate content) of 1%, 2%, 5% or 10% when held at pH 3.5 for 1 h.

In certain embodiments, an antibody or antigen-binding fragment of the present invention has increased or greater effector function as compared to the PGT-121 LO6 antibody. In particular embodiments, the effector function is increased, e.g., by at least 1%, at least 2%, at least 3%, at least 5%, at least 10%, at least 20%, at least 30%, at least 40%, at least 50%, at least 60%, at least 70%, at least 80%, at least 90%, at least 100%, at least 150%, at least 200%, at least 300%, at least 400%, at least 500%, at least 1000%, at least 1.5-fold, at least 2-fold, at least 3-fold, at least 5-fold, at least 10-fold, at least 20-fold, at least 30-fold, at least 50-fold, at least 100-fold, at least 1000-fold, or at least 10,000-fold. In particular embodiments, the effector function is ADCC, while in other embodiments, the effector function is ADCP. In particular embodiments, effector function of an antibody or antigen-binding fragment of the present invention ranges from no response (below limit of detection) observed at 100 µg/ml (~667 nM) to a potency in the 0.1 nM-1 µM range or the 0.1 nM-1 nM range.

Effector function may be measured using assays known or available in the art, including, e.g., those described in the accompanying Examples. In certain embodiments, ADCC is measured in an ex vivo ADCC reporter assay using engineered cells, such as donor cell infected with various strains of HIV; and ADCP is measure in an ex vivo ADCP assay using donor cells infected with various strains of HIV. In certain embodiments, ADCC is measured in an in vitro ADCCassay using primary NK effector cells from healthy donors and engineered CD4+ luciferase reporter T cell line infected with various strains of HIV; and ADCP is measure in an in vitro ADCP assay using donor cells infected with various strains of HIV. In certain embodiments, antibody-dependent effector cell activation is determined using cells, e.g., T cells, expressing human FcγRIIIA coupled to an NFAT-linked reporter gene Env expressing cells. In certain embodiments, antibody-dependent effector cell activation is determined using engineered cells, e.g., T cells, expressing human FcγRIIIA coupled to an NFAT-linked reporter gene co-cultured with HIV Env expressing cells. In particular embodiments, ADCC is determined in a cell-based assay using HIV-1-infected primary CD4+ T cells and autologous effector NK cells from healthy donors, which express FcγRIIIA and mediate antibody-mediated killing of infected cells via granzyme- and perforin-mediated cytotoxicity (ADCC), e.g., as described in the accompanying Examples. On certain embodiments, monocyte- and PBMC-mediated antibody-dependent cell killing is determined using HIV-1-infected CD4+ T cells as target cells and primary autologous PBMCs or isolated monocytes as effector cells, e.g., as described in the accompanying Examples, In certain embodiments, an antibody or antigen-binding fragment of the present invention shows increased or greater neutralization of HIV-1 as compared to the PGT-121 LO6 antibody. Neutralization may be determined using techniques known in the art. In particular embodiments, the HIV-1 is one particular strain, e.g., any of the strains described herein, e.g., an HIV subtype B isolate. In particular embodiments, neutralization is determined for a plurality of different strains, e.g., as an average over several or many different strains. For example, neutralization activity may be determined against a virus or a panel of viruses using the CEM-NKr-CCR5-LucR (modified CD4 T-cell line) or the JC53-BL (also called TZM-bl, modified HeLa cell-line) luciferase reporter cell-based infectivity assays (Li et al, 2005 JVir, 79(16), 10108-25). The assays may be run as single or multicycle viral replication assays depending on the virus used (pseudotyped or replication competent virus). Alternately neutralization activity may be determined using the U87.CCR5.CXCR4 cell line (modified CD4 T cell line) based infectivity assay using recombinant luciferase reporter viruses pseudotyped with patient HIV envelope proteins (Richman et al, 2003 PNAS, 100 (7), 4144-9). Examples of viruses that may be used include, but are not limited to, the lab adapted HIV-1 BaL strain and subtype B clinical isolates 93HT593, 92US657, 92US712 and 92US727 (NIH AIDS Reagent Program). In certain embodiments, neutralization is measured as described in Example 4 of PCT Application Publication No. WO2012/030904, or as described in the accompanying Examples. In particular embodiments, the neutralization of any particular strain, or the average neutralization of a plurality of different strains, is increased, e.g., by at least 10%, at least 20%, at least 30%, at least 40%, at least 50%, at least 60%, at least 70%, at least 80%, at least 90%, at least 100%, at least 150%, at least 200%, at least 300%, at least 400%, at least 500%, at least 1000%, at least 20-fold, at least 30-fold, at least 50-fold, at least 100-fold, or at least 1000-fold, or at least 10,000-fold. In certain embodiments, neutralization is increased for one or several strains, but there is no significant improvement of average neutralization for the plurality of strains tested In particular embodiments, antibodies or fragments thereof have an IC50 for neutralizing BaL of <0.02 or ≤0.015; HT593 of <0.2 or <0.16; US657 of <0.1; US712 of <0.25 or ≤0.20; and/or US727 of <0.1 or ≤0.02 or <0.015. In one embodiments, antibodies or fragments thereof may have an $IC_{50}$ for neutralizing BaL of <0.02 µg/ml or ≤0.015 µg/ml; HT593 of <0.2 µg/ml or <0.16 µg/ml; US657 of <0.1 µg/ml; US712 of <0.25 µg/ml or ≤0.20 µg/ml; and/or US727 of <0.1 µg/ml or <0.02 µg/ml or ≤0.015 µg/ml. In certain embodiments, the antibodies or antigen-binding fragments thereof may have a neutralization $IC_{50}$ range of 0.0005 µg/mL to 10 µg/mL for subtype B isolates. In some embodiments, the antibodies or antigen-binding fragments thereof may have a neutralization $IC_{50}$ range of 0.001 µg/mL to 3.3 µg/mL for subtype B DM and X4 isolates.

In certain embodiments, an antibody or antigen-binding fragment of the present invention has reduced or less immunogenicity as compared to the PGT-121 LO6 antibody. In certain embodiments, immunogenicity is determined using an assay known and available in the art or described in the accompanying Examples. In particular embodiments the location of T-cell epitopes is determined using EpiScreen™ T-cell epitope mapping, which involves a 50 donor ex-vivo peptide scanning T-cell activation assay as described (Baker et al. 2007. Drug Discovery Development 10(2): 219-227). In particular embodiments, the relative immunogenicity of engineered antibody variants is determined using a 50 donor ex-vivo whole molecule T-cell activation and cytokine release assays, which may be predictive of clinical immunogenicity as described (Jaber et al. 2007. J Pharm Biomed Anal. 43(4): 1256-1261). In particular embodiments, the donor response rate is reduced, e.g., by at least 5%, at least 10%, at least 20%, at least 30%, at least 40%, at least 50%, at least 60%, at least 70%, or at least 80%, as compared to the PGT-121 LO6 antibody. In particular embodiments the EpiScreen donor response is <10%, <15%, <20%, <25%, <30%, or <35%.

In particular embodiments, binding of the antibodies and fragments thereof of the present invention to the Env protein is predicted to involve regions of Env in or around the following residues (HIV Env HXB2 numbering): V3 loop (324-328, 330) and associated N332 glycan and a portion of the V1-loop (135-137) and associated N137 glycan, residues 415-417. Antibody paratope for Env binding is predicted to involve residues in the following regions that make direct contact with the antigen in the PGT-122-Env crystal structure (Kabat numbering): CDRH1 (33), CDRH2 (50, 56, 58), CDRH3 (99, 100, 100A-E, 100G, 100I, 100L), CDRL1 (28-30), CDRL2 (50-52), LFR3 (66, 67 67A-C) and CDRL3 (93, 94, 95A-95B).

In some aspect, the antibodies provided herein may be conjugated or linked to therapeutic and/or imaging/detectable moieties. Methods for conjugating or linking antibodies are well known in the art. Associations between antibodies and labels include any means known in the art including, but not limited to, covalent and non-covalent interactions. In one non-limiting embodiment, antibodies can be associated with a toxin, a radionuclide, an iron-related compound, a dye, an imaging reagent, a fluorescent label or a chemotherapeutic agent that would be toxic when delivered to a cancer cell. Alternatively, the antibodies can be associated with detectable label, such as a radionuclide, iron-related compound, a dye, an imaging agent or a fluorescent agent for immunodetection of target antigens. Non-limiting examples of radiolabels include, for example, 32P, 33P, 43K, 52Fe, 57Co, 64Cu, 67Ga, 67Cu, 68Ga, 71Ge, 75Br, 76Br, 77Br, 77As, 77Br, 81Rb/81MKr, 87MSr, 90Y, 97Ru, 99Tc, 100Pd, 101Rh, 103Pb, 105Rh, 109Pd, 111Ag, 111In, 113In, 119Sb, 121Sn, 123I, 125I, 127Cs, 128Ba, 129Cs, 131I, 131Cs, 143Pr, 153Sm, 161Tb, 166Ho, 169Eu, 177Lu, 186Re, 188Re, 189Re, 191Os, 193Pt, 194Ir, 197Hg, 199Au, 203Pb, 211At, 212Pb, 212Bi and 213Bi. Non-limiting examples of toxins include, for example, diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, tricothecenes, *Clostridium perfringens* phospholipase C (PLC), bovine pancreatic ribonuclease (BPR), antiviral protein (PAP), abrin, cobra venom factor (CVF), gelonin (GEL), saporin (SAP) viscumin. Non-limiting examples of iron-related compounds include, for example, magnetic iron-oxide particles, ferric or ferrous particles, Fe203 and Fe304. Iron-related compounds and methods of labeling polypeptides, proteins and peptides can be found, for example, in U.S. Pat. Nos. 4,101,435 and 4,452,773, and U.S. published applications 20020064502 and 20020136693, all of which are hereby incorporated by reference in their entirety. In certain embodiments, the subject antibodies can be covalently or non-covalently coupled to a cytotoxin or other cell proliferation inhibiting compound, in order to localize delivery of that agent to a tumor cell. For instance, the agent can be selected from the group consisting agents, enzyme inhibitors, proliferation inhibitors, lytic agents, DNA or RNA synthesis inhibitors, membrane permeability modifiers, DNA metabolites, dichloroethylsulfide derivatives, protein production inhibitors, ribosome inhibitors, inducers of apoptosis, and neurotoxins. In certain embodiments, the subject antibodies can be coupled with an agent useful in imaging tumors. Such agents include: metals; metal chelators; lanthanides; lanthanide chelators; radiometals; radiometal chelators; positron-emitting nuclei; microbubbles (for ultrasound); liposomes; molecules microencapsulated in liposomes or nanosphere; monocrystalline iron oxide nanocompounds; magnetic resonance imaging contrast agents; light absorbing, reflecting and/or scattering agents; colloidal particles; fluorophores, such as near-infrared fluorophores. In many embodiments, such secondary functionality/moiety will be relatively large, e.g., at least 25 amu in size, and in many instances can be at least 50,100 or 250 amu in size. In certain embodiments, the secondary functionality is a chelate moiety for chelating a metal, e.g., a chelator for a radiometal or paramagnetic ion. In additional embodiments, it is a chelator for a radionuclide useful for radiotherapy or imaging procedures. Radionuclides useful within the present invention include gamma-emitters, positron-emitters, Auger electron-emitters, X-ray emitters and fluorescence-emitters, with beta- or alpha-emitters preferred for therapeutic use. Examples of radionuclides useful as toxins in radiation therapy include: 32P, 33P, 43K, 52Fe, 57Co, 64Cu, 67Ga, 67Cu, 68Ga, 71Ge, 75Br, 76Br, 77Br, 77As, 77Br, 81Rb/81MKr, 87MSr, 90Y, 97Ru, 99Tc, 100Pd, 101Rh, 103Pb, 105Rh, 109Pd, 111Ag, 111In, 113In, 119Sb, 121Sn, 123I, 125I, 127Cs, 128Ba, 129Cs, 131I, 131Cs, 143Pr, 153Sm, 161Tb, 166Ho, 169Eu, 177Lu, 186Re, 188Re, 189Re, 191Os, 193Pt, 194Ir, 197Hg, 199Au, 203Pb, 211At, 212Pb, 212Bi and 213Bi. Preferred therapeutic radionuclides include 188Re, 186Re, 203Pb, 212Pb, 212Bi, 109Pd, 64Cu, 67Cu, 90Y, 125I, 131I, 77Br, 211At, 97Ru, 105Rh, 198Au and 199Ag, 166Ho or 177Lu. Conditions under which a chelator will coordinate a metal are described, for example, by Gasnow et al. U.S. Pat. Nos. 4,831,175, 4,454,106 and 4,472,509, each of which is incorporated herein by reference. Within the present invention, "radionuclide" and "radiolabel" are interchangeable. 99Tc is a particularly attractive radioisotope for diagnostic applications, as it is readily available to all nuclear medicine departments, is inexpensive, gives minimal patient radiation doses, and has ideal nuclear imaging properties. It has a half-life of six hours which means that rapid targeting of a technetium-labeled antibody is desirable. Accordingly, in certain preferred embodiments, the modified antibodies include a chelating agent for technium. In still other embodiments, the secondary functionality can be a radiosensitizing agent, e.g., a moiety that increases the sensitivity of cells to radiation. Examples of radiosensitizing agents include nitroimidazoles, metronidazole and misonidazole (see: DeVita, V. T. in Harrison's Principles of Internal Medicine, p. 68, McGraw-Hill Book Co., NY, 1983, which is incorporated herein by reference). The modified antibodies that comprise a radiosensitizing agent as the active moiety are administered and localize at the target cell. Upon exposure of the individual to radiation, the radiosensitizing agent is "excited" and causes the death of the cell.

Antibody Sequences

Antibodies of the present invention comprise one or more polypeptide sequences of gamma heavy chains and lambda light chains of various antibodies described herein, and variants and antigen-binding fragments thereof. In certain embodiments, antibodies of the present invention (and variants thereof and antigen-binding fragments thereof) comprise a heavy chain variable region and/or light chain variable region of any of the various antibodies described herein. In particular embodiments, antibodies, variable regions thereof, and antigen-binding fragments thereof of the present invention include one or more amino acid sequence modifications as compared to the wild type PGT-121 LO6 antibody. Table 1 provides the following amino acid sequences for PGT121 LO6 and illustrative antibodies of the present invention: heavy chain, heavy chain CDRs 1-3 (Kabat, IMGT, Chothia and Honegger), light chain, light chain CDRs 1-3 (Kabat, IMGT, Chothia and Honegger). The PGT121 variant antibodies shown in Table 1 are identified by a PGT number, such as, e.g., PGT121.15 and/or by description of modifications as compared to PGT LO6. PGT121 LO6 may also be referred to as PGT121 WT (wild-type). Table 1 also provides amino acid sequences for illustrative PGT122 antibodies of the present invention: heavy chain, heavy chain CDRs 1-3 (Kabat, IMGT, Chothia and Honegger), light chain, light chain CDRs 1-3 (Kabat, IMGT, Chothia and Honegger). Table 1 also provides amino acid sequences for illustrative PGT123 antibodies of the present invention: heavy chain, heavy chain CDRs 1-3 (Kabat, IMGT, Chothia and Honegger), light chain, light chain CDRs 1-3 (Kabat, IMGT, Chothia and Honegger). In some embodiments, any of the antibodies or antigen-binding fragments thereof of the present disclosure are modified to comprise one or more tags. In certain embodiments, the one or more tags comprise an avidin tag.

In particular embodiments, any of the heavy chains or light chains described herein further comprises a signal peptide at the N-terminus. In various embodiments, the signal peptide used is "native" (derived from an antibody), endogenous (i.e., used by naturally secreted proteins, e.g. albumins) or engineered (e.g., designed in silico for encoding secretion for protein In particular embodiments, the signal peptide has any of the following sequences: MDPKGSLSWRILLFLSLAFELSYG (SEQ ID NO: 1) or MSVPTQVLGLLLLWLTDARC (SEQ ID NO: 2). In particular embodiments, the heavy chain includes the signal sequence: MDPKGSLSWRILLFLSLAFELSYG (SEQ ID NO: 1), and the light chain includes the signal sequence: MSVPTQVLGLLLLWLTDARC (SEQ ID NO: 2).

In particular embodiments, any of the antibodies or antigen-binding fragments thereof of the present invention are glycosylated. In particular embodiments, the glycosylation is a native glycosylation present in the PGT-121 LO6 antibody. In other embodiments, the glycosylation is a modified glycosylation, which, e.g., may be introduced post-translationally or through genetic engineering. In particular embodiments, the antibody of antigen-binding fragment thereof is afucosylated, e.g., at a glycosylation site present in the antibody or antigen-binding fragment thereof. Most approved monoclonal antibodies are of the IgG1 isotype, where two N-linked biantennary complex-type oligosaccharides are bound to the Fc region. The Fc region exercises the effector function of ADCC through its interaction with leukocyte receptors of the FcγR family. Afucosylated monoclonal antibodies are monoclonal antibodies engineered so that the oligosaccharides in the Fc region of the antibody do not have any fucose sugar units. When antibodies are afucosylated, they may have improved FcγIIIa binding and increased antibody-dependent cellular cytotoxicity (ADCC). In particular embodiments, antibodies and antigen-binding fragments thereof are afucosylated and comprise the DEAL modifications (i.e., S239D, I332E, G236A, and A330L by EU numbering) in their Fc regions.

The PGT-121 LO6 antibody comprises a gamma heavy chain having the amino acid sequence shown in Table 1. The variable region of the gamma heavy chain of the PGT-121 LO6 antibody is underlined in Table 1. The constant region of the heavy chain (Fc) constitutes the non-underlined sequence as shown in Table 1 for PGT-121 LO6. The gamma heavy chain CDRs of PGT-121 LO6 and illustrative antibodies and antigen-binding fragments thereof of the present invention are also provided in Table 1. The variable regions of the heavy and light chains of all illustrative antibodies and antigen-binding fragments thereof provided in Table 1 are underlined. The constant regions of the heavy and light chains of all illustrative antibodies and antigen-binding fragments thereof provided in Table 1 constitute the non-underlined sequences. In particular embodiments, antibodies and antigen binding fragments of the present invention comprise one or more PGT-121 LO6 gamma heavy chain CDRs as defined by any of the Kabat, IMGT, Chothia or Honegger antibody numbering schemes. In particular embodiments, antibodies and antigen binding fragments of the present invention comprise two or more, or all three of these gamma heavy chain CDRs. In particular embodiments, antibodies and antigen binding fragments of the present invention comprise all three of these gamma heavy chain CDRs, wherein the CDRs collectively comprise one or more, e.g., one, two, three, four, five, six, seven or eight amino acid modifications, e.g., amino acid substitutions, deletions or insertions (as compared to the corresponding sequence of PGT121 LO6). In further embodiments, antibodies and antigen binding fragments of the present invention comprise one or more PGT-122 gamma heavy chain CDRs as defined by any of the Kabat, IMGT, Chothia or Honegger antibody numbering schemes. In yet further embodiments, antibodies and antigen binding fragments of the present invention comprise one or more PGT-123 gamma heavy chain CDRs as defined by any of the Kabat, IMGT, Chothia or Honegger antibody numbering schemes. In certain embodiments, an antibody or antigen binding fragment thereof of the present invention comprises a heavy chain, heavy chain variable region, or heavy chain constant region having the sequence of any of the antibodies shown in Table 1, or having at least 90%, at least 95%, at least 98%, or at least 99% sequence identity or homology thereto.

The coding sequence of the polynucleotide sequence encoding the gamma heavy chain of PGT-121 LO6 is shown below:

(SEQ ID NO: 3)
ATGAAACACCTGTGGTTCTTCCTTCTCCTGGTGGCAGCTCCCAGATGGGT

CCTGTCACAGATGCAGTTACAGGAGTCGGGCCCCGGACTGGTGAAGCCTT

CGGAAACCCTGTCCCTCACGTGCAGTGTGTCTGGTGCCTCCATAAGTGAC

AGTTACTGGAGCTGGATCCGGCGGTCCCCAGGGAAGGGACTTGAGTGGAT

TGGGTATGTCCACAAAAGCGGCGACACAAATTACAGCCCCTCCCTCAAGA

GTCGAGTCAACTTGTCGTTAGACACGTCCAAAAATCAGGTGTCCCTGAGC

CTTGTGGCCGCGACCGCTGCGGACTCGGGCAAATATTATTGCGCGAGAAC

ACTGCACGGGAGGAGAATTTATGGAATCGTTGCCTTCAATGAGTGGTTCA

CCTACTTCTACATGGACGTCTGGGGCAATGGGACTCAGGTCACCGTCTCC

TCAGCCTCCACCAAGGGCCCATCGGTCTTCCCCCTGGCACCCTCCTCCAA

GAGCACCTCTGGGGGCACAGCGGCCCTGGGCTGCCTGGTCAAGGACTACT

TCCCCGAACCGGTGACGGTGTCGTGGAACTCAGGCGCCCTGACCAGCGGC

GTGCACACCTTCCCGGCTGTCCTACAGTCCTCAGGACTCTACTCCCTCAG

CAGCGTGGTGACCGTGCCCTCCAGCAGCTTGGGCACCCAGACCTACATCT

GCAACGTGAATCACAAGCCCAGCAACACCAAGGTGGACAAGAGAGTTGAG

CCCAAATCTTGTGACAAAACTCACACATGCCCACCGTGCCCAGCACCTGA

ACTCCTGGGGGACCGTCAGTCTTCCTCTTCCCCCCAAAACCCAAGGACA

CCCTCATGATCTCCCGGACCCCTGAGGTCACATGCGTGGTGGTGGACGTG

AGCCACGAAGACCCTGAGGTCAAGTTCAACTGGTACGTGGACGGCGTGGA

GGTGCATAATGCCAAGACAAAGCCGCGGGAGGAGCAGTACAACAGCACGT

ACCGTGTGGTCAGCGTCCTCACCGTCCTGCACCAGGACTGGCTGAATGGC

```
-continued
AAGGAGTACAAGTGCAAGGTCTCCAACAAAGCCCTCCCAGCCCCATCGA

GAAAACCATCTCCAAAGCCAAAGGGCAGCCCCGAGAACCACAGGTGTACA

CCCTGCCCCATCCCGGGAGGAGATGACCAAGAACCAGGTCAGCCTGACC

TGCCTGGTCAAAGGCTTCTATCCCAGCGACATCGCCGTGGAGTGGGAGAG

CAATGGGCAGCCGGAGAACAACTACAAGACCACGCCTCCCGTGCTGGACT

CCGACGGCTCCTTCTTCCTCTATAGCAAGCTCACCGTGGACAAGAGCAGG

TGGCAGCAGGGGAACGTCTTCTCATGCTCCGTGATGCATGAGGCTCTGCA

CAACCACTACACGCAGAAGAGCCTCTCCCTGTCTCCGGGTAAATGA.
```

The coding region of the polynucleotide encoding the gamma heavy chain variable region of PGT-121 LO6 is shown below:

```
                                    (SEQ ID NO: 4)
CAGATGCAGTTACAGGAGTCGGGCCCCGGACTGGTGAAGCCTTCGGAAAC

CCTGTCCCTCACGTGCAGTGTGTCTGGTGCCTCCATAAGTGACAGTTACT

GGAGCTGGATCCGGCGGTCCCCAGGGAAGGGACTTGAGTGGATTGGGTAT

GTCCACAAAAGCGGCGACACAAATTACAGCCCCTCCCTCAAGAGTCGAGT

CAACTTGTCGTTAGACACGTCCAAAAATCAGGTGTCCCTGAGCCTTGTGG

CCGCGACCGCTGCGGACTCGGGCAAATATTATTGCGCGAGAACACTGCAC

GGGAGGAGAATTTATGGAATCGTTGCCTTCAATGAGTGGTTCACCTACTT

CTACATGGACGTCTGGGGCAATGGGACTCAGGTCACCGTCTCCTCA.
```

The PGT-121 LO6 antibody comprises a lambda light chain having the amino acid sequence shown in Table 1. The PGT-121 LO6 antibody lambda light chain variable region amino acid sequence is shaded in Table 1. The variable regions of the other antibodies in Table 1 may be determined by comparison. The lambda light chain Kabat CDRs of PGT-121 LO6 and illustrative antibodies and antigen-binding fragments thereof of the present invention are shown in Table 1. In particular embodiments, antibodies and antigen binding fragments of the present invention comprise one or more PGT-121 LO6 lambda light chain CDRs as defined by any of the Kabat, IMGT, Chothia or Honegger antibody numbering schemes. In particular embodiments, antibodies and antigen binding fragments of the present invention comprise two or more, or all three of these light chain CDRs. In particular embodiments, antibodies and antigen binding fragments of the present invention comprise all three of these light chain CDRs, wherein the CDRs collectively comprise one or more, e.g., one, two, three, four, five, six, seven or eight amino acid modifications, e.g., amino acid substitutions, deletions or insertions (as compared to the corresponding sequence of PGT121 LO6. In further embodiments, antibodies and antigen binding fragments of the present invention comprise one or more PGT-122 light chain CDRs as defined by any of the Kabat, IMGT, Chothia or Honegger antibody numbering schemes. In yet further embodiments, antibodies and antigen binding fragments of the present invention comprise one or more PGT-123 light chain CDRs as defined by any of the Kabat, IMGT, Chothia or Honegger antibody numbering schemes. In certain embodiments, an antibody or antigen binding fragment thereof of the present invention comprises a light chain or light chain variable region having the sequence of any of the antibodies shown in Table 1, or having at least 90%, at least 95%, at least 98%, or at least 99% sequence identity or homology thereto.

The coding region of the polynucleotide encoding the lambda light chain of PGT-121 LO6 is shown below:

```
                                    (SEQ ID NO: 19)
ATGGCCTGGACCTTTCTCCTCCTCGGCCTCCTCTCTCACTGCACAGCCTC

TGTGACCTCCGATATATCTGTGGCCCCAGGAGAGACGGCCAGGATTTCCT

GTGGGGAAAAGAGCCTTGGAAGTAGAGCTGTACAATGGTATCAACACAGG

GCCGGCCAGGCCCCCTCTTTAATCATATATAATAATCAGGACCGGCCCTC

AGGGATCCCTGAGCGATTCTCTGGCTCCCCTGACTCCCCTTTTGGGACCA

CGGCCACCCTGACCATCACCAGTGTCGAAGCCGGGGATGAGGCCGACTAT

TACTGTCATATATGGGATAGTAGAGTTCCCACCAAATGGGTCTTCGGCGG

AGGGACCACGCTGACCGTGTTAGGTCAGCCCAAGGCTGCCCCCTCGGTCA

CTCTGTTCCCGCCCTCCTCTGAGGAGCTTCAAGCCAACAAGGCCACACTG

GTGTGTCTCATAAGTGACTTCTACCCGGGAGCCGTGACAGTGGCCTGGAA

GGCAGATAGCAGCCCCGTCAAGGCGGGAGTGGAGACCACCACACCCTCCA

AACAAAGCAACAACAAGTACGCGGCCAGCAGCTACCTGAGCCTGACGCCT

GAGCAGTGGAAGTCCCACAAAAGCTACAGCTGCCAGGTCACGCATGAAGG

GAGCACCGTGGAGAAGACAGTGGCCCCTACAGAATGTTCATAG.
```

The coding region of the polynucleotide encoding the lambda light chain variable region of PGT-121 LO6 is shown below:

```
                                    (SEQ ID NO: 20)
TCCGATATATCTGTGGCCCCAGGAGAGACGGCCAGGATTTCCTGTGGGGA

AAAGAGCCTTGGAAGTAGAGCTGTACAATGGTATCAACACAGGGCCGGCC

AGGCCCCCTCTTTAATCATATATAATAATCAGGACCGGCCCTCAGGGATC

CCTGAGCGATTCTCTGGCTCCCCTGACTCCCCTTTTGGGACCACGGCCAC

CCTGACCATCACCAGTGTCGAAGCCGGGGATGAGGCCGACTATTACTGTC

ATATATGGGATAGTAGAGTTCCCACCAAATGGGTCTTCGGCGGAGGGACC

ACGCTGACCGTGTTA.
```

In certain embodiments, an antibody or fragment thereof of the present invention comprises one or more, two or more, three or more, four or more, five or more, or all six of the CDRs present in the PGT-121 LO6 antibody, as defined by any of the Kabat, IMGT, Chothia or Honegger numbering schemes. In particular embodiments, antibodies and antigen binding fragments of the present invention comprise all six of these CDRs, wherein the CDRs collectively comprise one or more, e.g., one, two, three, four, five, six, seven or eight amino acid modifications, e.g., amino acid substitutions, deletions or insertions. In certain embodiments, an antibody or fragment thereof of the present invention comprises one or more, two or more, three or more, four or more, five or more, or all six of the CDRs present in any of the antibodies shown in Table 1. In other embodiments, one or more of the PGT-121 LO6 CDRs is replaced, e.g., by one or more corresponding CDRs of another anti-HIV antibody. In particular embodiments, one or more of the PGT-121 LO6 CDRs is replaced by one or more corresponding CDRs from the PGT-122, PGT-123, PGT-124, PGT-133, or PGT-134 antibodies described in PCT Publication WO2012/030904. Corresponding CDRs are CDRs at the same position in the other antibody, such as heavy chain CDRs 1, 2, and 3, and light chain CDRs 1, 2 and 3, so a replacement with a corresponding CDR indicates replacement of a heavy chain CDR1 with a different heavy chain CDR1, replacement of a light chain CDR1 with a different CDR1, etc. The CDR sequences of these antibodies are provided below:

i. Allotype Modifications

IgG antibodies exist in various allotypes and isoallotypes. In particular embodiments, antibodies and antigen-binding fragments thereof of the present invention include an IgG1 heavy chain having an allotype of G1m1; nG1m2; G1m3;

TABLE 2

CDRs of PGT antibodies

| Ab | HC CDR1 | HC CDR2 | HC CDR3 | LC CDR1 | LC CDR2 | LC CDR3 |
|---|---|---|---|---|---|---|
| PGT-122 | DNYWS (Kabat) (SEQ ID NO: 5) GTLVDR (Chothia) (SEQ ID NO: 6) | YHDSGDTNYN PSLKS (Kabat) (SEQ ID NO: 13) YVHDSGDTN (Chothia) (SEQ ID NO: 14) | TKHGRRIYGV VAFKEWFTYF YMDV (Kabat) (SEQ ID NO: 23) TKHGRRIYGV VAFKEWFTYF YMDV (Chothia) (SEQ ID NO: 23) | GEESLGSRSVI (Kabat) (SEQ ID NO: 29) GEESLGSRSVI (Chothia) (SEQ ID NO: 29) | NNNDRPS (Kabat) (SEQ ID NO: 34) NNNDRPS (Chothia) (SEQ ID NO: 34) | HIWDSRRPT NWV (Kabat) (SEQ ID NO: 37) HIWDSRRPT NWV (Chothia) (SEQ ID NO: 37) |
| PGT-123 | DAYWS (Kabat) (SEQ ID NO: 7) GASIND (Chothia) (SEQ ID NO: 8) | YVHHSGDTNY NPSLKR (Kabat) (SEQ ID NO: 15) YVHHSGDTN (Chothia) (SEQ ID NO: 16) | ALHGKRIYGIV ALGELFTYFY MDV (Kabat) (SEQ ID NO: 24) ALHGKRIYGIV ALGELFTYFY MDV (Chothia) (SEQ ID NO: 24) | GKESIGSRAV Q (Kabat) (SEQ ID NO: 30) GKESIGSRAV Q (Chothia) (SEQ ID NO: 30) | NNQDRPA (Kabat) (SEQ ID NO: 35) NNQDRPA (Chothia) (SEQ ID NO: 35) | HIYDARGGT NWV (Kabat) (SEQ ID NO: 38) HIYDARGGT NWV (Chothia) (SEQ ID NO: 38) |
| PGT-124 | NYYWT (Kabat) (SEQ ID NO: 9) GGSISN (Chothia) (SEQ ID NO: 10) | YISDRETTTYN PSLNS (Kabat) (SEQ ID NO: 17) YISDRETTT (Chothia) (SEQ ID NO: 18) | ARRGQRIYGV VSFGEFFYYY YMDV (Kabat) (SEQ ID NO: 25) ARRGQRIYGV VSFGEFFYYY YMDV (Chothia) (SEQ ID NO: 25) | GRQALGSRAV Q (Kabat) (SEQ ID NO: 31) GRQALGSRAV Q (Chothia) (SEQ ID NO: 31) | NNQDRPS (Kabat) (SEQ ID NO: 36) NNQDRPS (Chothia) (SEQ ID NO: 36) | HMWDSRSG FSWS (Kabat) (SEQ ID NO: 39) HMWDSRSG FSWS (Chothia) (SEQ ID NO: 39) |
| PGT-133 | GRFWS (Kabat) (SEQ ID NO: 11) NGSVSG (Chothia) (SEQ ID NO: 12) | YFSDTDRSEY NPSLRS (Kabat) (SEQ ID NO: 21) YFSDTDRSE (Chothia) (SEQ ID NO: 22) | AQQGKRIYGI GSFGEFFYYY YMDA (Kabat) (SEQ ID NO: 26) AQQGKRIYGI VSFGEFFYYY YMDA (Chothia) (SEQ ID NO: 27) | GERSRGSRAV A (Kabat) (SEQ ID NO: 32) GERSRGSRAV Q (Chothia) (SEQ ID NO: 33) | NNQDRPA (Kabat) (SEQ ID NO: 35) NNQDRPA (Chothia) (SEQ ID NO: 35) | HYWDSRSPI SWI (Kabat) (SEQ ID NO: 40) HYWDSRSPI SWI (Chothia) (SEQ ID NO: 40) |
| PGT-134 | GRFWS (Kabat) (SEQ ID NO: 11) NGSVSG (Chothia) (SEQ ID NO: 12) | YFSDTDRSEY NPSLRS (Kabat) (SEQ ID NO: 21) YFSDTDRSE (Chothia) (SEQ ID NO: 22) | AQQGKRIYGI VSFGELFYYY YMDA (Kabat) (SEQ ID NO: 28) AQQGKRIYGI VSFGELFYYY YMDA (Chothia) (SEQ ID NO: 28) | GERSRGSRAV Q (Kabat) (SEQ ID NO: 33) GERSRGSRAV Q (Chothia) (SEQ ID NO: 33) | NNQDRPA (Kabat) (SEQ ID NO: 35) NNQDRPA (Chothia) (SEQ ID NO: 35) | HYWDSRSPI SWI (Kabat) (SEQ ID NO: 40) HYWDSRSPI SWI (Chothia) (SEQ ID NO: 40) |

Antibodies of the present invention and antigen-binding fragments thereof comprise one or more amino acid modifications as compared to PGT-121 LO6. These may include any of a variety of different types of modifications, including, e.g., allotype modification, Fc modifications, Fab modifications, and modification of selected residues, such as glycosylation sites. Non-limiting examples of modifications present in certain embodiments of antibodies and antigen-binding fragments thereof of the present invention are described herein and shown in the sequences set forth in Table 1.

G1m17,1; G1m17,1,2; G1m3,1; or G1m17. Each of these allotypes or isoallotypes is characterized by the following amino acid residues at the indicated positions within the IgG1 heavy chain constant region (Fc)(EU numbering):

G1m1: D356, L358;
nG1m1: E356, M358;
G1m3: R214, E356, M358, A431;
G1m17,1: K214, D356, L358, A431;
G1m17,1,2: K214, D356, L358, G431;
G1m3,1: R214, D356, L358, A431; and
G1m17: K214, E356, M358, A431.

The PGT-121 LO6 antibody comprises the IgG1m3 allotype. In particular embodiments, the antibodies and antigen-binding fragments thereof of the present invention comprise the IgG1m3 allotype, whereas in other embodiments, the allotype is modified as compared to the PGT-121 LO6 antibody. In particular embodiments, the allotype is nG1m1, G1m3; G1m17,1; G1m17,1,2; G1m3,1; or G1m17. In certain embodiments, the allotype is G1m17. In particular embodiments, an antibody of antigen-binding fragment thereof comprises an IgG1 heavy chain constant region comprising one of the following amino acid sequences, in which representative allotype-determining residues are indicated in bold:

IgG1m3:
(SEQ ID NO: 41)
ASTKGPSVFPLAPSSKSTSGGTAALGCLVKDYFPEPVTVSWNSGALTSGV

HTFPAVLQSSGLYSLSSVVTVPSSSLGTQTYICNVNEEKPSNTKVDKRVE

PKSCDKTHTCPPCPAPELLGGPSVFLFPPKPKDTLMISRTPEVTCVVVDV

SREDPEVKFNWYVDGVEVHNAKTKPREEQYNSTYRVVSVLTVLHQDWLNG

KEYKCKVSNKALPAPIEKTISKAKGQPREPQVYTLPPSREEMTKNQVSLT

CLVKGFYPSDIAVEWESNGQPENNYKTTPPVLDSDGSFFLYSKLTVDKSR

WQQGNVFSCSVMHEALHNHYTQKSLSLSPGK;

IgG1m17,1:
(SEQ ID NO: 42)
ASTKGPSVFPLAPSSKSTSGGTAALGCLVKDYFPEPVTVSWNSGALTSGV

HTFPAVLQSSGLYSLSSVVTVPSSSLGTQTYICNVNEEKPSNTKVDKKVE

PKSCDKTHTCPPCPAPELLGGPSVFLFPPKPKDTLMISRTPEVTCVVVDV

SREDPEVKFNWYVDGVEVHNAKTKPREEQYNSTYRVVSVLTVLHQDWLNG

KEYKCKVSNKALPAPIEKTISKAKGQPREPQVYTLPPSRDELTKNQVSLT

CLVKGFYPSDIAVEWESNGQPENNYKTTPPVLDSDGSFFLYSKLTVDKSR

WQQGNVFSCSVMHEALHNHYTQKSLSLSPGK;

IgG1m17,1,2:
(SEQ ID NO: 43)
ASTKGPSVFPLAPSSKSTSGGTAALGCLVKDYFPEPVTVSWNSGALTSGV

HTFPAVLQSSGLYSLSSVVTVPSSSLGTQTYICNVNEEKPSNTKVDKKVE

PKSCDKTHTCPPCPAPELLGGPSVFLFPPKPKDTLMISRTPEVTCVVVDV

SREDPEVKFNWYVDGVEVHNAKTKPREEQYNSTYRVVSVLTVLHQDWLNG

KEYKCKVSNKALPAPIEKTISKAKGQPREPQVYTLPPSRDELTKNQVSLT

CLVKGFYPSDIAVEWESNGQPENNYKTTPPVLDSDGSFFLYSKLTVDKSR

WQQGNVFSCSVMHEGLHNHYTQKSLSLSPGK;

IgG1m3,1:
(SEQ ID NO: 44)
ASTKGPSVFPLAPSSKSTSGGTAALGCLVKDYFPEPVTVSWNSGALTSGV

HTFPAVLQSSGLYSLSSVVTVPSSSLGTQTYICNVNEEKPSNTKVDKRVE

PKSCDKTHTCPPCPAPELLGGPSVFLFPPKPKDTLMISRTPEVTCVVVDV

SREDPEVKFNWYVDGVEVHNAKTKPREEQYNSTYRVVSVLTVLHQDWLNG

KEYKCKVSNKALPAPIEKTISKAKGQPREPQVYTLPPSRDELTKNQVSLT

CLVKGFYPSDIAVEWESNGQPENNYKTTPPVLDSDGSFFLYSKLTVDKSR

WQQGNVFSCSVMHEALHNHYTQKSLSLSPGK;

or

IgG1m17:
(SEQ ID NO: 45)
ASTKGPSVFPLAPSSKSTSGGTAALGCLVKDYFPEPVTVSWNSGALTSGV

HTFPAVLQSSGLYSLSSVVTVPSSSLGTQTYICNVNEEKPSNTKVDKKVE

PKSCDKTHTCPPCPAPELLGGPSVFLFPPKPKDTLMISRTPEVTCVVVDV

SEEEDPEVKFNWYVDGVEVHNAKTKPREEQYNSTYRVVSVLTVLHQDWLN

GKEYKCKVSNKALPAPIEKTISKAKGQPREPQVYTLPPSREEMTKNQVSL

TCLVKGFYPSDIAVEWESNGQPENNYKTTPPVLDSDGSFFLYSKLTVDKS

RWQQGNVFSCSVMHEALHNHYTQKSLSLSPGK.

In certain embodiments, an antibody or an antigen-binding fragment thereof of the present invention comprises an IgG1 heavy chain comprising the following amino acid sequence of allotype IgG1m17:

(SEQ ID NO: 46)
QMQLQESGPGLVKPSETLSLTCSVSGASISDSYWSWIRRSPGKGLEWIGY

VIAKSGDTNYSPSLKSRVNLSLDTSKNQVSLSLVAATAADSGKYYCARTL

HGRRIYGIVAFNEWFTYFYMDVWGNGTQVTVSSASTKGPSVFPLAPSSKS

TSGGTAALGCLVKDYFPEPVTVSWNSGALTSGVHTFPAVLQSSGLYSLSS

VVTVPSSSLGTQTYICNVNRKPSNTKVDKKVEPKSCDKTHTCPPCPAPEL

LGGPSVFLFPPKPKDTLMISRTPEVTCVVVDVSEEEDPEVKFNWYVDGVE

VHNAKTKPREEQYNSTYRVVSVLTVLHQDWLNGKEYKCKVSNKALPAPIE

KTISKAKGQPREPQVYTLPPSREEMTKNQVSLTCLVKGFYPSDIAVEWES

NGQPENNYKTTPPVLDSDGSFFLYSKLTVDKSRWQQGNVFSCSVMHEALH

NHYTQKSLSLSPGK.

In particular embodiments, antibodies and antigen-binding fragments thereof of the present invention comprise a kappa light chain having an allotype selected from Km1; Km1,2; or Km3. Each of these allotypes is characterized by the following amino acid residues at the indicated positions within the IgG1 light chain (EU numbering):
Km1: V153, L191;
Km1,2: A153, L191; and
Km3: A153, V191.

In particular embodiments, an antibody of antigen-binding fragment thereof comprises an IgG1 kappa light chain comprising one of the following amino acid sequences, in which representative allotype-determining residues are indicated in bold:

Km1:
(SEQ ID NO: 47)
TVAAPSVFIFPPSDEQLKSGTASVVCLLNNFYPREAKVQWKVDNVLQSGN

SQESVTEQDSKDSTYSLSSTLTLSKADYEKHKLYACEVTHQGLSSPVTKS

FNRGEC;

Km1,2:
(SEQ ID NO: 48)
TVAAPSVFIFPPSDEQLKSGTASVVCLLNNFYPREAKVQWKVDNALQSGN

SQESVTEQDSKDSTYSLSSTLTLSKADYEKHKLYACEVTHQGLSSPVTKS

FNRGEC;

or

Km3:

(SEQ ID NO: 49)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

Each individual human includes between seven and eleven different lambda light chain genes, which encode light chains selected from Lambda1, Lambda2, Lambda3, Lambda4, Lambda5, Lambda6, and Lambda7. In particular embodiments, antibodies and antigen-binding fragments thereof of the present invention comprise a lambda light chain selected from Lambda1, Lambda2, Lambda3, Lambda4, Lambda5, Lambda6, and Lambda7. In particular embodiments, antibodies and antigen-binding fragments thereof of the present invention comprise a lambda light chain selected from Lambda1, Lambda2, Lambda3, and Lambda 7. In particular embodiments, an antibody of antigen-binding fragment thereof comprises an IgG1 lambda light chain comprising one of the following amino acid sequences, in which representative lambda-determining residues are indicated in bold:

IGLC1:

(SEQ ID NO: 50)
GQPKANPTVTLFPPSSEELQANKATLVCLISDFYPGAVTVAWKADGSPVK

AGVETTKPSKQSNNKYAASSYLSLTPEQWKSHRSYSCQVTHEGSTVEKTV

APTECS;

IGLC2:

(SEQ ID NO: 51)
GQPKAAPSVTLFPPSSEELQANKATLVCLISDFYPGAVTVAWKADSSPVK

AGVETTTPSKQSNNKYAASSYLSLTPEQWKSHRSYSCQVTHEGSTVEKTV

APTECS;

IGLC3:

(SEQ ID NO: 52)
GQPKAAPSVTLFPPSSEELQANKATLVCLISDFYPGAVTVAWKADSSPAK

AGVETTTPSKQSNNKYAASSYLSLTPEQWKSHKSYSCQVTHEGSTVEKTV

APTECS;
or

IGLC7:

(SEQ ID NO: 53)
GQPKAAPSVTLFPPSSEELQANKATLVCLVSDFYPGAVTVAWKADGSPVK

VGVETTKPSKQSNNKYAASSYLSLTPEQWKSHRSYSCRVTHEGSTVEKTV

APAECS.

In particular embodiments, the light chain comprises the amino acid sequence:

(SEQ ID NO: 54)
SDISVAPGETARISCGEKSLGSRAVQWYQHRAGQAPSLITYNNQDRPSGI

PERFSGSPDSPFGTTATLTITSVEAGDEADYYCHIWDSRVPTKWVFGGGT

TLTVLGQPKAAPSVTLFPPSSEELQANKATLVCLISDFYPGAVTVAWKAD

SSPVKAGVETTTPSKQSNNKYAASSYLSLTPEQWKSHRSYSCQVTHEGST

VEKTVAPTECS.

In particular embodiments, an antibody or antibody binding fragment thereof of the present invention comprises any of the light chain sequences set forth in Table 1 or sequences having at least 90%, at least 95%, at least 98%, or at least 99% identity thereto.

In particular embodiments, an antibody or antigen-binding fragment thereof comprises an IgG1 heavy chain having the IgG1m17 allotype and a Lambda2 light chain.

In certain embodiments, the light chain comprises one or more of the following amino acid substitutions (as compared to PGT121 LO6 using Kabat numbering scheme in FIG. 1): Arg at position 67b, Pro at position 67c, and Lys at position 103. In certain embodiments, the light chain comprises the following amino acid substitutions (as compared to PGT121 LO6 using Kabat numbering scheme in FIG. 1): Arg at position 67b and Pro at position 67c.

ii. Fc Modifications

In certain embodiments, antibodies and antigen-binding fragments thereof include one or more amino acid sequence modifications in the heavy chain constant region (Fc) as compared to the PGT-121 LO6 antibody. In particular embodiments, these modifications increase stability or increase binding affinity of the modified antibody or antigen-binding fragment thereof as compared to the PGT-121 LO6 antibody. In particular embodiments, certain of these modifications, or combinations thereof, surprisingly increase antibody effector function or neutralization activity. The sequence of certain illustrative heavy chain sequences comprising one or more Fc modifications, and antibodies comprising such modified heavy chain sequences, are shown in Table 1.

In certain embodiments, the one or more modifications are selected from the following Fc amino acid substitutions (as compared to PGT121 LO6; EU numbering) or combinations thereof: L234F; L235E; G236A; S239D; F243L; D265E; S267E; H268F; R292P; N297Q; S298A; S324T; I332E; S239D; A330L; L234F; L235E; P331S; F243L; Y300L; V305I; P396L; S298A; E333A; K334A; E345R; L235V; F243L; R292P; Y300L; P396L; M428L; E430G; N434S; G236A, S267E, H268F, S324T, and I332E; G236A, S239D, and I332E; S239D, A330L, I332E; L234F, L235E, and P331S; F243L, R292P, Y300L, V305I, and P396L; G236A, H268F, S324T, and I332E; S239D, H268F, S324T, and I332E; S298A, E333A, and K334A; L235V, F243L, R292P, Y300L, and P396L; S239D, I332E; S239D, S298A, and I332E; G236A, S239D, I332E, M428L, and N434S; G236A, S239D, A330L, I332E, M428L, and N434S; S239D, I332E, G236A and A330L; M428L and N4343S; M428L, N434S; G236A, S239D, A330L, and I332E; and G236A and I332E.

In particular embodiments, the antibodies and antigen-binding fragments comprise two or more, three or more, four or more, five or more, or six or more modified Fc amino acid residues. In certain embodiments, the antibodies and antigen-binding fragments thereof comprise the S239D, I332E, G236A and A330L mutations, which are collectively referred to as DEAL. In certain embodiments, the antibodies and antigen-binding fragments thereof comprise the M428L and N434S mutations, which are collectively referred to as LS. In certain embodiments, the antibodies and antigen-binding fragments thereof comprise the S239D, I332E, G236A, A330L, M428L and N434S mutations (DEALLS). In particular embodiments, antibodies and antigen-binding fragments thereof of the present invention comprise one of the heavy chain constant region sequences present in any of the antibodies set forth in Table 1 of a variant thereof having at least 90%, at least 95%, at least 98%, or at least 99% sequence identity or homology thereto.

In particular embodiments, the antibodies and antigen-binding fragments are afucosylated. In some embodiments, the antibodies and antigen-binding fragments comprise one or more tags. In certain embodiments, the one or more tags comprise an avidin tag.

iii. Fab Modifications

In certain embodiments, antibodies and antigen-binding fragments thereof include one or more amino acid sequence modifications in a heavy chain variable region or a light chain variable region (Fab) as compared to the PGT-121 LO6 antibody. In particular embodiments, these modifications increase stability or increase binding affinity of the modified antibody or antigen-binding fragment thereof as compared to the PGT-121 LO6 antibody. In certain embodiments, these modifications reduce immunogenicity, isomerization, glycosylation or oxidation of the antibodies or antigen-binding fragments thereof. In particular embodiments, the modification results in the removal of a potential site of isomerization, glycosylation or oxidation from the antibodies or antigen-binding fragments thereof. In certain embodiments, the amino acid substitutions result in increased translation of the antibodies or antigen-binding fragments thereof. In certain embodiments, these modifications increase the % recovery of monomeric IgG from a low pH viral inactivation procedure. In certain embodiments, these modifications increase the HIV neutralization potency of the antibodies or antigen-binding fragments thereof as compared to the PGT-121 LO6 antibody when measured against either a single HIV strain, or a sub-set of related HIV strains.

In particular embodiments, the modification comprises an amino acid substitution within one or more potential glycosylation sites located in the PGT-121 LO6 antibody. N-linked glycosylation sites may comprise the sequence NX(S/T) where X is any amino acid residue except proline, and wherein the N is glycosylated. In particular embodiments, the glycosylation sites are located at residues 58, 68 and 105 (Kabat numbering) of the PGT-121 LO6 heavy chain variable region sequence. In particular embodiments, an antibody or antigen-binding fragment thereof of the present invention comprises one or more amino acid substitutions within residues 58-60, 68-70 and 105-107 (Kabat numbering) of the heavy chain Fab as compared to PGT-121 LO6, which eliminates the NX(S/T) glycosylation consensus sequence. In certain embodiments, the one or more amino acid substitutions occur at positions 60, 68 or 105 (Kabat numbering). In particular embodiments, the amino acid substitutions remove or destroy the glycosylation site at the modified position. In certain embodiments, the antibodies or antigen-binding fragments thereof of the present invention comprise two or more or three or more amino acid substitutions at these glycosylation sites. In one embodiment, they comprise amino acid substitutions that remove or destroy all three of these glycosylation sites.

In particular embodiments, the modification comprises an amino acid substitution within one or more potentially immunogenic regions located in the PGT-121 LO6 antibody. In particular embodiments, the potential immunogenic regions are located at residues 82a-82c of the PGT-121 LO6 heavy chain variable region. In particular embodiments, an antibody or antigen-binding fragment thereof of the present invention comprises one or more amino acid substitutions within residues 82a-82c (Kabat numbering) of the heavy chain Fab as compared to PGT-121 LO6. In certain embodiments, the one or more amino acid substitutions occur at positions 82a-82c (Kabat numbering) of the heavy chain Fab as compared to PGT-121 LO6. In particular embodiments, the amino acid substitutions reduce the immunogenicity of the antibodies or antigen-binding fragments thereof. In certain embodiments, the antibodies or antigen-binding fragments thereof of the present invention comprise two or more or three or more amino acid substitutions in this immunogenic region. In one embodiment, they comprise amino acid substitutions of three residues in this immunogenic region, e.g., the substitution of the VAA present in PGT-121 LO6, e.g., with SSV, TSV or TGV. In certain embodiments, an antibody or antigen-binding fragment thereof of the present invention comprises one or more amino acid substitutions that remove a glycosylation site and in which the immunogenicity is less than or equal to that of PGT-121 LO6. In certain embodiments, the antibodies comprise one or more amino acid modifications, e.g., substitutions, within a determined or predicted immunogenic region corresponding to any of the regions of PGT-121 LO6 shown in any of Tables 14-16.

In particular embodiments, the antibodies comprise modification in any combination at heavy chain residues 2, 32, 60, 68, 82a-82c, 95, or 105 and/or light chain residues 67b, 67c, or 103 resulting in reduced donor response in a whole molecule T-cell activation assay described herein.

In certain embodiments, the antibodies or antigen-binding fragments thereof include one or more amino acid modification, e.g., substitutions, to enhance translation. For example, the substitution may be of an amino acid encoded by a rare codon, or for which there is only a limited amount of corresponding tRNA present in the cells in which the protein is expressed. In certain embodiments, antibodies or antigen-binding fragments thereof of the present invention comprise one or more such modifications, or amino acid substitutions, e.g., as compared to PGT-121 LO6. In particular embodiments, the antibodies or antigen-binding fragments thereof comprise an amino acid substitution of one or more of M2, A28, R39, N68, S81, V82a, A82b, A82c or N105 (Kabat numbering) in the PGT-121 LO6 antibody's heavy chain variable region. In certain embodiments, R39 of PGT-121 LO6 is substituted, e.g., by a Q.

In certain embodiments, the antibodies or antigen-binding fragments thereof include one or more amino acid substitutions to enhance stability of the Fab domain as measured by melting temperature. In particular embodiments, the antibodies or antigen-binding fragments thereof comprise one or more of the following amino acid substitutions in a heavy chain: R39Q, S60N and VAA(82a-82c)SSV (Kabat numbering). As shown in the accompanying Examples, antibodies of the present invention show enhanced thermal stability as compared to PTG-121 LO6, as measured by an increase in Fab domain Tm determined by DSF. In particular embodiments, the antibodies or antigen-binding fragments thereof comprise an amino acid substitution of in a heavy chain of R39Q, S60N and VAA(82a-82c)TGV (Kabat numbering). In particular embodiments, the antibodies or antigen-binding fragments thereof comprise the amino acid substitution in a heavy chain of VAA(82a-82c)SSV (Kabat numbering). In particular embodiments, the antibodies or antigen-binding fragments thereof comprise an amino acid substitution of in a heavy chain of VAA(82a-82c)TGV (Kabat numbering).

In certain embodiments, the antibodies or antigen-binding fragments thereof include one or more amino acid substitutions to enhance stability of the Fab domain at low pH, preventing aggregation during a low "pH hold" procedure used to inactivate potential viruses derived from mammalian cell culture during purification of antibodies such as PGT- 121 LO6. In particular embodiments, the antibodies or antigen-binding fragments thereof comprise an amino acid substitution of one or more of the following heavy chain mutations: Q1E, M2V, M2L, A27G, S32A, R39Q, S60N, N68T, N68H, S81K, VAA(82a-82c)SSV, VAA(82a-82c) TSV, VAA(82a-82c)TGV, K89T, T95A, N105K, N105H, N105Q, N105T; light chain mutations K95cN or S45V; or the combination of heavy chain mutation R39Q plus light chain mutation H38Q. In particular embodiments, the antibodies or antigen-binding fragments thereof comprise addition of either SYVLTQP or SSVTSYV to the N-terminus of the light chain, as well as the combination of these additions with any of the aforementioned substitutions. As described in the accompanying Examples, antibodies of the present invention show enhanced stability at low pH as compared to PGT-121 LO6, which enables GMP production of these molecules. This may be found in WHO Technical Report, Series No. 924, 2004; Jacob and Frech. 2004. Scale up of antibody purification: from laboratory scale to production, p. 101-132. In G. Subramanian (ed.), *Antibodies*, vol. 1. *Production and Purification*. Kluwer Academic/Plenum Publishers, New York, N.Y.

In certain embodiments, the antibodies or antigen-binding fragments thereof include one or more amino acid substitutions to enhance HIV neutralization potency and breadth. As shown in the accompanying Examples, certain antibodies of the present invention show a statistically significant improvement in both breadth and neutralization potency (~2-3 fold) as compared to PGT-121 LO6 or other antibodies.

In certain embodiments, the one or more modifications are selected from the following heavy chain Fab mutations (Kabat numbering) or combinations thereof (as compared to PGT121 LO6): Q1E; M2V; M2L; A27G; S32A; R39Q; S60N; N68T; N68H; S81K; V82aT; V82aS; A82bG; A82bS; A82cV; K89T; T95A; W100jA; W100jL; N105K; N105Q; N105T; N105H; S60A; N68A; N105A; N105H; N105T; S60N, N68T and N105K; S32A, S60N, N68T and N105K; S60N, N68T and N105K; V82aS; A82bS; A82cV; V82aT, A82bG; and A82cV. In certain embodiments, the heavy chain Fab comprises the following mutations (Kabat numbering): S60N, N68H, VAA82a-cTGV, and N105T. In certain embodiments, the heavy chain Fab comprises the following mutations (Kabat numbering): S60N, N68H, VAA82a-cSSV, and N105K. In certain embodiments, the heavy chain Fab comprises the following mutations (Kabat numbering): S60N, N68H, VAA82a-cSSV, and N105H. In certain embodiments, the heavy chain Fab comprises the following mutations (Kabat numbering): M2L, S32A, S60N, N68H, VAA82a-cTGV, T95A and N105T. In certain embodiments, the heavy chain Fab comprises the following mutations (Kabat numbering): R39Q, S60N, N68H, VAA82a-cSSV, and N105K.

In particular embodiments, the antibodies and antigen-binding fragments thereof of the present invention comprise one or more, two or more, three or more, or four or more amino acid substitutions in the heavy chain Fab, wherein the amino acid substitution are selected from the following combinations of substitutions (EU numbering): V82aS A82bS, A82cV, and N105K; N68H, V82aS, A82bS, and A82cV; N68H, V82aS A82bS, A82cV, and N105K; S60N, V82aS A82bS, and A82cV; S60N, N105K; S60N, and N68H; S60N, N68H, and N105K; R39Q; R39Q, N68H, and N105K; R39Q and N68H; R39Q and N105K; R39Q and S60N; R39Q, S60N, and N105K; R39Q, S60N, and N68H; R39Q, S60N, N68H, and N105K; V82aS, A82bS, and A82cV; S60N, N68H, VAA82a-cTGV, and N105T; S60N, N68H, VAA82a-cSSV, and N105K; S60N, N68H, VAA82a-cSSV, and N105H; M2L, S32A, S60N, N68H, VAA82a-cTGV, T95A and N105T; and R39Q, S60N, N68H, VAA82a-cSSV, and N105K. In some embodiments, the antibodies and antigen-binding fragments thereof of the present invention comprise one or more, two or more, three or more, four or more, five or more, or six or more amino acid substitutions in the heavy chain Fab, wherein the amino acid substitution are selected from the following combinations of substitutions (EU numbering): V82aS A82bS, A82cV, and N105K; N68H, V82aS, A82bS, and A82cV; N68H, V82aS A82bS, A82cV, and N105K; S60N, V82aS A82bS, and A82cV; S60N, N105K; S60N, and N68H; S60N, N68H, and N105K; R39Q; R39Q, N68H, and N105K; R39Q and N68H; R39Q and N105K; R39Q and S60N; R39Q, S60N, and N105K; R39Q, S60N, and N68H; R39Q, S60N, N68H, and N105K; V82aS, A82bS, and A82cV; S60N, N68H, VAA82a-cTGV, and N105T; S60N, N68H, VAA82a-cSSV, and N105K; S60N, N68H, VAA82a-cSSV, and N105H; M2L, S32A, S60N, N68H, VAA82a-cTGV, T95A and N105T; and R39Q, S60N, N68H, VAA82a-cSSV, and N105K. In particular embodiments, any of these antibodies or antigen-binding fragments thereof further comprise one or more, two or more, three or more, four or more, or five or more of the following Fc mutations (EU numbering): G236A, S239D, A330L, I332E, M428L, and N434S. In particular embodiments, they comprise four, five, six, or seven of these amino acid substitutions in the heavy chain Fab. In particular embodiments, they further comprise all of the following Fc mutations (EU numbering): G236A, S239D, A330L, I332E, M428L, and N434S. In particular embodiments, they further comprise the G1m17 allotype. In some embodiments, the antibodies and antigen-binding fragments thereof of the present invention comprise six heavy chain variable domain mutations. In other embodiments, the antibodies and antigen-binding fragments thereof of the present invention comprise two light chain variable domain mutations. In certain embodiments, the antibodies and antigen-binding fragments thereof of the present invention comprise six heavy chain variable domain mutations and two light chain variable domain mutations. Embodiments of the present invention include any combinatorial variant derived from any of the mutations described herein.

In particular embodiments, an antibody or antigen-binding fragment thereof of the present invention comprises one or more amino acid modifications in the light chain as compared to PGT121 LO6. In particular embodiments, the one or more modification are selected from the following light chain mutations: P67bR, F67 cP and T103K (Kabat numbering). In one embodiments, the one or more modification are selected from the following light chain amino acid substitutions: P67bR, F67 cP and T103K (Kabat numbering). In particular embodiments, the antibody or antigen binding fragment thereof comprises the following light chain mutations: P67bR, F67 cP and T103K. In certain embodiments, the one or more modifications are selected from the following light chain Fab mutations (Kabat numbering) or combinations thereof: SYVLTQP at N-terminus; SSVTSYV at N-terminus; S45T; or K95cN. In certain embodiments, the one or more modifications are selected from the following light chain Fab mutations (Kabat numbering) or combinations thereof: SYVLTQP at N-terminus; SSVTSYV at N-terminus; S45T; or K95cN.

In certain embodiments, an antibody or antigen-binding fragment thereof comprises one or more modifications selected from the following combination of heavy chain Fab mutations and light chain Fab mutations (Kabat numbering):

HC: R39Q and LC: H38Q; HC: S60N, N68T and N105K and LC: SYVLTPQ at N-terminus; HC: S60N, N68H, VAA82a-cTGV, N105T and LC: P67bR and F67 cP; HC: S60N, N68H, VAA82a-cTGV, N105T and LC: P67bR, F67 cP and T103K; HC: M2L, S32A, S60N, N68H, VAA82a-cTGV, N105T and LC: P67bR and F67 cP; or HC: M2L, S32A, S60N, N68H, VAA82a-cTGV, N105T and LC: P67bR, F67 cP and T103K. In one embodiments, an antibody or antigen-binding fragment thereof comprises one or more modifications selected from the following combination of heavy chain Fab mutations and light chain Fab mutations (Kabat numbering): HC: R39Q and LC: H38Q; HC: S60N, N68T and N105K and LC: SYVLTPQ at N-terminus; HC: S60N, N68H, VAA82a-cTGV, N105T and LC: P67bR and F67 cP; HC: S60N, N68H, VAA82a-cTGV, N105T and LC: P67bR, F67 cP and T103K; HC: M2L, S32A, S60N, N68H, VAA82a-cTGV, N105T and LC: P67bR and F67 cP; HC: M2L, S32A, S60N, N68H, VAA82a-cTGV, N105T and LC: P67bR, F67 cP and T103K; HC: S60N, N68H, VAA82a-cSSV, N105K and LC: P67bR and F67 cP. In particular embodiments, the antibody or antigen-binding fragment thereof has sequence identity of at least 80%, at least 85%, at least 90%, at least 95%, at least 98%, or at least 99% to the corresponding region of the PGT121 LO6 antibody. In further embodiments, it comprises all six CDRs present in the PTG121 LO6 antibody by Kabat numbering.

In particular embodiments, the antibodies and antigen-binding fragments comprise two or more, three or more, four or more, five or more, or six or more of any of the Fab mutations described herein or shown in any of the PGT121 LO6 mutant sequences provided in Table 1. In certain embodiments, any of these antibodies and antigen-binding fragments thereof further comprise one or more of the following heavy chain constant region mutations: S239D, I332E, G236A and A330L (EU numbering). In certain embodiments, any of these antibodies and antigen-binding fragments thereof comprise the M428L and N434S mutations. In certain embodiments, any of the antibodies and antigen-binding fragments thereof comprise the S239D, I332E, G236A, A330L, M428L and N434S mutations.

In particular embodiments, an antibody or fragment thereof of the present invention comprises any of the heavy chain sequences, constant regions thereof, or variable regions thereof, or light chain sequences, constant regions thereof, or variable regions thereof, shown in Table 1, or a variant having at least 90%, at least 95%, at least 98%, or at least 99% sequence identity thereto. In particular embodiments, antibodies and antigen-binding fragments thereof of the present invention comprise one of the heavy chain Fab or variable domain sequences indicated by underlining in Table 1. In particular embodiments, antibodies and antigen-binding fragments thereof of the present invention comprise any of the heavy chains shown in Table 1. In certain embodiments, an antibody or fragment thereof of the present invention comprises both the heavy chain sequence and the light chain sequence present in any of the antibodies shown in Table 1, i.e., the combination present in any of the clone designations. In particular embodiments, an antibody or antigen-binding fragment of the present invention comprises a heavy chain having a sequence shown in Table 1 (or fragment thereof), and a light chain having a sequence shown in Table 1 (or fragment thereof), wherein the heavy chain and light chain are not present in the same antibody in Table 1. Any of the heavy chains shown in Table 1 (or fragments thereof) may be combined with any of the light chains shown in Table 1 (or fragments thereof).

In particular embodiments, an antibody or fragment thereof of the present invention comprises one or modifications in the light chain variable region as compared to PGT-121 LO6. In certain embodiments, the modification is selected from the following amino acid substitutions: P67bR, F67 cP, or T103K.

In particular embodiments, an antibody or fragment thereof of the present invention comprises one of the light chain variable regions shown in underlining in Table 1 or shown below:

```
                                       (SEQ ID NO: 55)
SDISVAPGETARISCGEKSLGSRAVQWYQHRAGQAPSLIIYNNQDRPSGI

PERFSGSPDSPFGTTATLTITSVEAGDEADYYCHIWDSRVPTKWVFGGGT

TLTVLG;
                                       (SEQ ID NO: 56)
SDISVAPGETARISCGEKSLGSRAVQWYQHRAGQAPSLIIYNNQDRPSGI

PERFSGSPDSPFGTTATLTITSVEAGDEADYYCHIWDSRVPTKWVFGGGT

KLTVLG;
                                       (SEQ ID NO: 57)
SDISVAPGETARISCGEKSLGSRAVQWYQHRAGQAPSLIIYNNQDRPSGI

PERFSGSPDSRPGTTATLTITSVEAGDEADYYCHIWDSRVPTKWVFGGGT

TLTVLG;
or
                                       (SEQ ID NO: 58)
SDISVAPGETARISCGEKSLGSRAVQWYQHRAGQAPSLIIYNNQDRPSGI

PERFSGSPDSRPFGTTATLTITSVEAGDEADYYCHIWDSRVPTKWVFGGG

TKLTVLG.
```

In certain embodiments, the invention includes antigen-binding fragments of antibodies. In certain circumstances there are advantages of using antibody fragments, rather than whole antibodies. For example, the smaller size of the fragments allows for rapid clearance, and may lead to improved access to certain tissues, such as solid tumors. Examples of antibody fragments include: Fab, Fab', F(ab')2 and Fv fragments; diabodies; linear antibodies; single-chain antibodies; nanobodies, and multispecific antibodies formed from antibody fragments.

In other embodiments, the antibody of choice is a single chain Fv fragment (scFv). See WO 93/16185; U.S. Pat. Nos. 5,571,894; and 5,587,458. Fv and sFv are the only species with intact combining sites that are devoid of constant regions. Thus, they are suitable for reduced nonspecific binding during in vivo use. sFv fusion proteins may be constructed to yield fusion of an effector protein at either the amino or the carboxy terminus of an sFv. See Antibody Engineering, ed. Borrebaeck, supra. The antibody fragment may also be a linear antibody, e.g., as described in U.S. Pat. No. 5,641,870 for example. Such linear antibody fragments may be monospecific or bispecific.

In particular embodiments, an antibody or antigen-binding fragment thereof comprises the heavy chain complementary determining regions (CDRs) and light chain CDRs of PGT 121 LO6 (defined by any numbering scheme), wherein the antibody or antigen-binding fragment thereof comprises one or more, two or more, three or more, or all four of the following features:

(A) the heavy chain is an allotype other than IgG1m3 (e.g., G1m17, G1m1, nG1m1, G1m2, nG1m2, G1m17,1, G1m17,1,2 or G1m3,1), wherein in particular embodiments, the allotype is IgG1m17 allotype;

(B) the light chain is Lambda2;

(C) the heavy chain constant region (Fc) comprises one or more amino acid substitutions as compared to the Fc of PGT-121 LO6 at one or more of position 236, position 239, position 330, position 332, position 428, and position 434, wherein in particular embodiments, the one or more amino acid substitutions are selected from: Ala at position 236, Asp at position 239, Leu at position 330, Glu at position 332, Leu at position 428, and Ser at position 434; and (D) the heavy chain variable region (Fab) comprises one or more amino acid substitutions of a glycosylation site present in the Fab of PGT-121 LO6 or an immunogenic region in the Fab of PGT-121 LO6, wherein in particular embodiments, the glycosylation sites present in the Fab of PGT-121 LO6 are located at positions 58-60, 68-70 and 105-107 and the immunogenic region in the Fab of PGT-121 LO6 is located at positions 82a-82c, and wherein in certain embodiments, the one or more amino acid substitutions is selected from: Ser-Ser-Val at positions 82a-82c, Thr-Gly-Val at positions 82a-82c, Gln at position 39, Asn at position 60, His at position 68, Lys at position 105, Thr at position 105, and His at position 105.

In particular embodiments, the antibody or antigen-binding fragment thereof comprises any of the following combination of features identified above: A and B; A and C; A and D; B and C; B and D; C and D; A, B and C; A, B and D; A, C and D; B, C and D; or A, B, C and D.

In particular embodiments of any of the antibodies or antigen-binding fragments thereof described herein, the heavy chain is IgG1m17 allotype.

In particular embodiments of any of the antibodies or antigen-binding fragments thereof described herein, the heavy chain constant region (Fc) comprises Ala at position 236, Asp at position 339, Leu at position 330, Glu at 332, Leu at 428, and Ser at position 434.

In particular embodiments of any of the antibodies or antigen-binding fragments thereof described herein, the heavy chain constant region (Fc) comprises Lys at position 214, Glu at position 356, Met at position 358, and Ala at position 431.

In particular embodiments of any of the antibodies or antigen-binding fragments thereof described herein, the heavy chain constant region (Fc) comprises the heavy chain sequence of PGT121.33.

In one embodiments of any of the antibodies or antigen-binding fragments thereof described herein, the heavy chain constant region (Fc) comprises the heavy chain sequence of PGT121.42, PGT121.43, PGT121.60, PGT121.61, PGT121.54, PGT121.55, PGT121.64, and PGT121.65. In other embodiments of any of the antibodies or antigen-binding fragments thereof described herein, the heavy chain constant region (Fc) is set forth in any of SEQ ID NOs: 252, 255, 266, 267, 268, 269, 272, and 273.

In particular embodiments of any of the antibodies or antigen-binding fragments thereof described herein, the light chain is Lambda2. In particular embodiments of any of the antibodies or antigen-binding fragments thereof described herein, the light chain comprises Ala at position 6, Ser at position 8, Ile at position 30, Ser at position 46, Val at position 49, Ala at position 5, Thr at position 57, Arg at position 83, Gln at position 88 and Thr at position 103. In particular embodiments of any of the antibodies or antigen-binding fragments thereof described herein, the light chain comprises any of the light chain sequences or variable regions thereof shown in Table 1. In some embodiments of any of the antibodies or antigen-binding fragments thereof described herein, the light chain region comprises the light chain sequence of PGT121.42, PGT121.43, PGT121.60, PGT121.61, PGT121.54, PGT121.55, PGT121.64, and PGT121.65. In certain embodiments of any of the antibodies or antigen-binding fragments thereof described herein, the light chain is set forth in any of SEQ ID NOs: 338, 341, 352, 353, 354, 355, 358, and 359.

In particular embodiments of any of the antibodies or antigen-binding fragments thereof described herein, the heavy chain variable region (Fab) comprises amino acid substitution at two or more or all three glycosylation sites present in PGT-121 LO6. In particular embodiments, the heavy chain variable region (Fab) comprises one or more of: Ser-Ser-Val at positions 82a-82c, Thr-Gly-Val at positions 82a-82c, Gln at position 39, Asn at position 60, His at position 68, Lys at position 105, Thr at position 105 and His at position 105. In particular embodiments of any of the antibodies or antigen-binding fragments thereof described herein, the heavy chain variable region (Fab) comprises Ser-Ser-Val at positions 82a-82c or Thr-Gly-Val at positions 82a-82c. In particular embodiments, the heavy chain variable region (Fab) comprises Asn at position 60, His at position 68, Lys at position 105, Thr at position 105 and His at position 105. In particular embodiments, the heavy chain variable region (Fab) comprises: Ser-Ser-Val at positions 82a-82c, Thr-Gly-Val at positions 82a-82c, Gln at position 39, Asn at position 60, His at position 68, Lys at position 105, Thr at position 105 and His at position 105. In particular embodiments of any of the antibodies or antigen-binding fragments thereof described herein, the heavy chain variable region comprises any of the heavy chain variable regions shown in Table 1.

In particular embodiments, the antibody or antigen-binding fragment thereof comprises a heavy chain (or fragment thereof) and/or a light chain (or fragment thereof) having a sequence shown in Table 1. In particular embodiments, it has a combination of any heavy chain and any light chain shown in Table 1. In particular embodiments, the antibody or antigen-binding fragment thereof comprises a heavy chain (or fragment thereof) set forth in SEQ ID NOs: 404, 423, 425, 427, 429 and 449. In particular embodiments, the antibody or antigen-binding fragment thereof comprises a light chain (or fragment thereof) set forth in SEQ ID NOs: 415, 424, 426, 428, 430 and 450. In some embodiments, the disclosure provides for an antibody, or an antigen-binding fragment thereof, comprising the heavy chain complementary determining regions 1-3 (CDRs 1-3) set forth in SEQ ID NOs: 363, 405 and 406 and the light chain CDRs 1-3 set forth in SEQ ID NOs: 416, 417 and 418. In some embodiments, the disclosure provides for an antibody, or an antigen-binding fragment thereof, comprising the heavy chain complementary determining regions 1-3 (CDRs 1-3) set forth in SEQ ID NOs: 362, 364 and 367 and the light chain CDRs 1-3 set forth in SEQ ID NOs: 395, 396 and 397. In some embodiments, the disclosure provides for an antibody, or an antigen-binding fragment thereof, comprising the heavy chain complementary determining regions 1-3 (CDRs 1-3) set forth in SEQ ID NOs: 362, 366 and 367 and the light chain CDRs 1-3 set forth in SEQ ID NOs: 395, 396 and 397. In some embodiments, the disclosure provides for an antibody, or an antigen-binding fragment thereof, comprising the heavy chain complementary determining regions 1-3 (CDRs 1-3) set forth in SEQ ID NOs: 431, 432 and 433 and the light chain CDRs 1-3 set forth in SEQ ID NOs: 442, 443 and 444.

The present invention also includes nucleic acid molecules encoding an antibody or antigen-binding fragment thereof of the present invention. In particular embodiments, the nucleic acid molecules encode an antibody light chain (or a fragment thereof) or an antibody light chain (or a fragment thereof), or both. In certain embodiments, the nucleic acid encodes a bivalent antibody or fragment thereof. In particular embodiments, the nucleic acid is a DNA, a cDNA or an mRNA. In particular embodiments, the nucleic acid molecule is codon-optimized to enhance expression in a host cell.

The invention further includes polypeptide variants of antibody and antigen-binding fragments thereof disclosed herein, including, e.g., intact antibodies, scFvs, heavy chains, light chains, $V_H$ regions, and $V_L$ regions. In certain embodiments, the invention includes a polypeptide variant having at least 70%, at least 75%, at least 80%, at least 85%, at least 90%, at least 95%, at least 98%, or at least 99% homology with a polypeptide described herein, including any of those shown in Table 1.

The invention further includes nucleic acid molecules that encode polypeptide variants of antibody and antigen-binding fragments thereof disclosed herein, as well as polynucleotide variants of nucleic acid molecules encoding an antibody or antigen-binding fragment thereof of the present invention, such as, e.g., intact antibodies, scFvs, heavy chains, light chains, $V_H$ regions, and $V_L$ regions. In certain embodiments, the invention includes a polynucleotide variant having at least 70%, at least 75%, at least 80%, at least 85%, at least 90%, at least 95%, at least 98%, or at least 99% homology with a polynucleotide described herein.

In certain embodiments of the nucleic acid molecules, they (or parts or subregions thereof) may be codon optimized. Codon optimization methods are known in the art and may be used, e.g., to match codon frequencies in target and host organisms, to ensure proper folding, bias GC content to increase mRNA stability or reduce secondary structures, minimize tandem repeat codons or base runs that may impair gene construction or expression, customize transcriptional and translational control regions, insert or remove protein trafficking sequences, modify ribosome binding sites and mRNA degradation sites, to adjust translational rates to allow the various domains of the protein to fold properly, or to reduce or eliminate problem secondary structures within the polynucleotide. Codon optimization tools, algorithms and services are known in the art, non-limiting examples include services from GeneArt (Life Technologies), DNA2.0 (Menlo Park Calif.) and/or proprietary methods. In one embodiment, the nucleic acid sequence is optimized using optimization algorithms. Examples of codon options for each amino acid are given in Table 3.

TABLE 3

Codon Options

| Amino Acid | Single Letter Code | Codon Options |
|---|---|---|
| Isoleucine | I | ATT, ATC, ATA |
| Leucine | L | CTT, CTC, CTA, CTG, TTA, TTG |
| Valine | V | GTT, GTC, GTA, GTG |
| Phenylalanine | F | TTT, TTC |
| Methionine | M | ATG |
| Cysteine | C | TGT, TGC |
| Alanine | A | GCT, GCC, GCA, GCG |
| Glycine | G | GGT, GGC, GGA, GGG |
| Proline | P | CCT, CCC, CCA, CCG |

TABLE 3-continued

Codon Options

| Amino Acid | Single Letter Code | Codon Options |
|---|---|---|
| Threonine | T | ACT, ACC, ACA, ACG |
| Serine | S | TCT, TCC, TCA, TCG, AGT, AGC |
| Tyrosine | Y | TAT, TAC |
| Tryptophan | W | TGG |
| Glutamine | Q | CAA, CAG |
| Asparagine | N | AAT, AAC |
| Histidine | H | CAT, CAC |
| Glutamic acid | E | GAA, GAG |
| Aspartic acid | D | GAT, GAC |
| Lysine | K | AAA, AAG |
| Arginine | R | CGT, CGC, CGA, CGG, AGA, AGG |
| Selenocysteine | Sec | UGA in mRNA in presence of Selenocystein insertion element (SECIS) |
| Stop codons | Stop | TAA, TAG, TGA |

The present invention also includes vectors comprising a nucleic acid molecule of the invention. A vector can be of any type, for example, a recombinant vector such as an expression vector. Vectors include, but are not limited to, plasmids, cosmids, bacterial artificial chromosomes (BAC) and yeast artificial chromosomes (YAC) and vectors derived from bacteriophages or plant or animal (including human) viruses. Vectors can comprise an origin of replication recognized by the proposed host cell and in the case of expression vectors, promoter and other regulatory regions recognized by the host cell. In particular embodiments, a vector comprises a polynucleotide encoding an antibody or antigen-biding fragment thereof of the invention operably linked to a promoter and optionally additional regulatory elements. Certain vectors are capable of autonomous replication in a host into which they are introduced (e.g., vectors having a bacterial origin of replication can replicate in bacteria). Other vectors can be integrated into the genome of a host upon introduction into the host, and thereby are replicated along with the host genome. Vectors include, but are not limited to, those suitable for recombinant production of the antibodies and antigen-binding fragments thereof of the invention, as well as those suitable for introducing into a subject in need thereof, or a cell thereof, in order to provide an antibody or antigen-binding fragment thereof of the invention to the subject.

The choice of the vector is dependent on the recombinant procedures followed and the host used. Introduction of vectors into host cells can be effected by inter alia calcium phosphate transfection, virus infection, DEAE-dextran-mediated transfection, lipofectamin transfection or electroporation. Vectors may be autonomously replicating or may replicate together with the chromosome into which they have been integrated. In certain embodiments, the vectors contain one or more selection markers. The choice of the markers may depend on the host cells of choice. These include, but are not limited to, kanamycin, neomycin, puromycin, hygromycin, zeocin, thymidine kinase gene from Herpes simplex virus (HSV-TK), and dihydrofolate reductase gene from mouse (dhfr). Vectors comprising one or more nucleic acid molecules encoding the antibodies and antigen binding fragments thereof described herein, operably linked to one or more nucleic acid molecules encoding proteins or peptides that can be used to isolate the antibodies and fragments thereof, are also covered by the disclosure. These proteins or peptides include, but are not limited to, glutathione-S-transferase, maltose binding protein, metal-binding polyhistidine, green fluorescent protein, luciferase and beta-galactosidase.

In particular embodiments, the vector is pcDNA™3.1+ (ThermoFisher, MA), which has the following sequence:

(SEQ ID NO: 59)
GACGGATCGGGAGATCTCCCGATCCCCTATGGTGCACTCTCAGTACAATCTGCTCTG

ATGCCGCATAGTTAAGCCAGTATCTGCTCCCTGCTTGTGTGTTGGAGGTCGCTGAGT

AGTGCGCGAGCAAAATTTAAGCTACAACAAGGCAAGGCTTGACCGACAATTGCATG

AAGAATCTGCTTAGGGTTAGGCGTTTTGCGCTGCTTCGCGATGTACGGGCCAGATAT

ACGCGTTGACATTGATTATTGACTAGTTATTAATAGTAATCAATTACGGGGTCATTA

GTTCATAGCCCATATATGGAGTTCCGCGTTACATAACTTACGGTAAATGGCCCGCCT

GGCTGACCGCCCAACGACCCCCGCCCATTGACGTCAATAATGACGTATGTTCCCATA

GTAACGCCAATAGGGACTTTCCATTGACGTCAATGGGTGGAGTATTTACGGTAAACT

GCCCACTTGGCAGTACATCAAGTGTATCATATGCCAAGTACGCCCCCTATTGACGTC

AATGACGGTAAATGGCCCGCCTGGCATTATGCCCAGTACATGACCTTATGGGACTTT

CCTACTTGGCAGTACATCTACGTATTAGTCATCGCTATTACCATGGTGATGCGGTTTT

GGCAGTACATCAATGGGCGTGGATAGCGGTTTGACTCACGGGGATTTCCAAGTCTCC

ACCCCATTGACGTCAATGGGAGTTTGTTTTGGCACCAAAATCAACGGGACTTTCCAA

AATGTCGTAACAACTCCGCCCCATTGACGCAAATGGGCGGTAGGCGTGTACGGTGG

GAGGTCTATATAAGCAGAGCTCTCTGGCTAACTAGAGAACCCACTGCTTACTGGCTT

ATCGAAATTAATACGACTCACTATAGGGAGACCCAAGCTGGCTAGCGTTTAAACTTA

AGCTTGGTACCGAGCTCGGATCCACTAGTCCAGTGTGGTGGAATTCTGCAGATATCC

AGCACAGTGGCGGCCGCTCGAGTCTAGAGGGCCCGTTTAAACCCGCTGATCAGCCT

CGACTGTGCCTTCTAGTTGCCAGCCATCTGTTGTTTGCCCCTCCCCCGTGCCTTCCTT

GACCCTGGAAGGTGCCACTCCCACTGTCCTTTCCTAATAAAATGAGGAAATTGCATC

GCATTGTCTGAGTAGGTGTCATTCTATTCTGGGGGGTGGGGTGGGGCAGGACAGCA

AGGGGGAGGATTGGGAAGACAATAGCAGGCATGCTGGGGATGCGGTGGGCTCTATG

GCTTCTGAGGCGGAAAGAACCAGCTGGGGCTCTAGGGGGTATCCCCACGCGCCCTG

TAGCGGCGCATTAAGCGCGGCGGGTGTGGTGGTTACGCGCAGCGTGACCGCTACAC

TTGCCAGCGCCCTAGCGCCCGCTCCTTTCGCTTTCTTCCCTTCCTTTCTCGCCACGTTC

GCCGGCTTTCCCCGTCAAGCTCTAAATCGGGGGCTCCCTTTAGGGTTCCGATTTAGT

GCTTTACGGCACCTCGACCCCAAAAAACTTGATTAGGGTGATGGTTCACGTAGTGGG

CCATCGCCCTGATAGACGGTTTTTCGCCCTTTGACGTTGGAGTCCACGTTCTTTAATA

GTGGACTCTTGTTCCAAACTGGAACAACACTCAACCCTATCTCGGTCTATTCTTTTGA

TTTATAAGGGATTTTGCCGATTTCGGCCTATTGGTTAAAAAATGAGCTGATTTAACA

AAAATTTAACGCGAATTAATTCTGTGGAATGTGTGTCAGTTAGGGTGTGGAAAGTCC

CCAGGCTCCCCAGCAGGCAGAAGTATGCAAAGCATGCATCTCAATTAGTCAGCAAC

CAGGTGTGGAAAGTCCCCAGGCTCCCCAGCAGGCAGAAGTATGCAAAGCATGCATC

TCAATTAGTCAGCAACCATAGTCCCGCCCCTAACTCCGCCCATCCCGCCCCTAACTC

CGCCCAGTTCCGCCCATTCTCCGCCCCATGGCTGACTAATTTTTTTTATTTATGCAGA

GGCCGAGGCCGCCTCTGCCTCTGAGCTATTCCAGAAGTAGTGAGGAGGCTTTTTTGG

AGGCCTAGGCTTTTGCAAAAAGCTCCCGGGAGCTTGTATATCCATTTTCGGATCTGA

TCAAGAGACAGGATGAGGATCGTTTCGCATGATTGAACAAGATGGATTGCACGCAG

GTTCTCCGGCCGCTTGGGTGGAGAGGCTATTCGGCTATGACTGGGCACAACAGACA

-continued

```
ATCGGCTGCTCTGATGCCGCCGTGTTCCGGCTGTCAGCGCAGGGGCGCCCGGTTCTT
TTTGTCAAGACCGACCTGTCCGGTGCCCTGAATGAACTGCAGGACGAGGCAGCGCG
GCTATCGTGGCTGGCCACGACGGGCGTTCCTTGCGCAGCTGTGCTCGACGTTGTCAC
TGAAGCGGGAAGGGACTGGCTGCTATTGGGCGAAGTGCCGGGGCAGGATCTCCTGT
CATCTCACCTTGCTCCTGCCGAGAAAGTATCCATCATGGCTGATGCAATGCGGCGGC
TGCATACGCTTGATCCGGCTACCTGCCCATTCGACCACCAAGCGAAACATCGCATCG
AGCGAGCACGTACTCGGATGGAAGCCGGTCTTGTCGATCAGGATGATCTGGACGAA
GAGCATCAGGGGCTCGCGCCAGCCGAACTGTTCGCCAGGCTCAAGGCGCGCATGCC
CGACGGCGAGGATCTCGTCGTGACCCATGGCGATGCCTGCTTGCCGAATATCATGGT
GGAAAATGGCCGCTTTTCTGGATTCATCGACTGTGGCCGGCTGGGTGTGGCGGACCG
CTATCAGGACATAGCGTTGGCTACCCGTGATATTGCTGAAGAGCTTGGCGGCGAATG
GGCTGACCGCTTCCTCGTGCTTTACGGTATCGCCGCTCCCGATTCGCAGCGCATCGC
CTTCTATCGCCTTCTTGACGAGTTCTTCTGAGCGGGACTCTGGGGTTCGAAATGACC
GACCAAGCGACGCCCAACCTGCCATCACGAGATTTCGATTCCACCGCCGCCTTCTAT
GAAAGGTTGGGCTTCGGAATCGTTTTCCGGGACGCCGGCTGGATGATCCTCCAGCGC
GGGGATCTCATGCTGGAGTTCTTCGCCCACCCCAACTTGTTTATTGCAGCTTATAATG
GTTACAAATAAAGCAATAGCATCACAAATTTCACAAATAAAGCATTTTTTTCACTGC
ATTCTAGTTGTGGTTTGTCCAAACTCATCAATGTATCTTATCATGTCTGTATACCGTC
GACCTCTAGCTAGAGCTTGGCGTAATCATGGTCATAGCTGTTTCCTGTGTGAATTG
TTATCCGCTCACAATTCCACACAACATACGAGCCGGAAGCATAAAGTGTAAAGCCT
GGGGTGCCTAATGAGTGAGCTAACTCACATTAATTGCGTTGCGCTCACTGCCCGCTT
TCCAGTCGGGAAACCTGTCGTGCCAGCTGCATTAATGAATCGGCCAACGCGCGGGG
AGAGGCGGTTTGCGTATTGGGCGCTCTTCCGCTTCCTCGCTCACTGACTCGCTGCGCT
CGGTCGTTCGGCTGCGGCGAGCGGTATCAGCTCACTCAAAGGCGGTAATACGGTTAT
CCACAGAATCAGGGGATAACGCAGGAAAGAACATGTGAGCAAAAGGCCAGCAAAA
GGCCAGGAACCGTAAAAAGGCCGCGTTGCTGGCGTTTTTCCATAGGCTCCGCCCCCC
TGACGAGCATCACAAAAATCGACGCTCAAGTCAGAGGTGGCGAAACCCGACAGGAC
TATAAAGATACCAGGCGTTTCCCCCTGGAAGCTCCCTCGTGCGCTCTCCTGTTCCGA
CCCTGCCGCTTACCGGATACCTGTCCGCCTTTCTCCCTTCGGGAAGCGTGGCGCTTTC
TCATAGCTCACGCTGTAGGTATCTCAGTTCGGTGTAGGTCGTTCGCTCCAAGCTGGG
CTGTGTGCACGAACCCCCCGTTCAGCCCGACCGCTGCGCCTTATCCGGTAACTATCG
TCTTGAGTCCAACCCGGTAAGACACGACTTATCGCCACTGGCAGCAGCCACTGGTAA
CAGGATTAGCAGAGCGAGGTATGTAGGCGGTGCTACAGAGTTCTTGAAGTGGTGGC
CTAACTACGGCTACACTAGAAGAACAGTATTTGGTATCTGCGCTCTGCTGAAGCCAG
TTACCTTCGGAAAAAGAGTTGGTAGCTCTTGATCCGGCAAACAAACCACCGCTGGTA
GCGGTTTTTTGTTTGCAAGCAGCAGATTACGCGCAGAAAAAAAGGATCTCAAGAA
GATCCTTTGATCTTTTCTACGGGGTCTGACGCTCAGTGGAACGAAAACTCACGTTAA
GGGATTTTGGTCATGAGATTATCAAAAAGGATCTTCACCTAGATCCTTTTAAATTAA
AAATGAAGTTTTAAATCAATCTAAAGTATATATGAGTAAACTTGGTCTGACAGTTAC
CAATGCTTAATCAGTGAGGCACCTATCTCAGCGATCTGTCTATTTCGTTCATCCATAG
```

-continued
```
TTGCCTGACTCCCCGTCGTGTAGATAACTACGATACGGGAGGGCTTACCATCTGGCC

CCAGTGCTGCAATGATACCGCGAGACCCACGCTCACCGGCTCCAGATTTATCAGCAA

TAAACCAGCCAGCCGGAAGGGCCGAGCGCAGAAGTGGTCCTGCAACTTTATCCGCC

TCCATCCAGTCTATTAATTGTTGCCGGGAAGCTAGAGTAAGTAGTTCGCCAGTTAAT

AGTTTGCGCAACGTTGTTGCCATTGCTACAGGCATCGTGGTGTCACGCTCGTCGTTTG

GTATGGCTTCATTCAGCTCCGGTTCCCAACGATCAAGGCGAGTTACATGATCCCCCA

TGTTGTGCAAAAAAGCGGTTAGCTCCTTCGGTCCTCCGATCGTTGTCAGAAGTAAGT

TGGCCGCAGTGTTATCACTCATGGTTATGGCAGCACTGCATAATTCTCTTACTGTCAT

GCCATCCGTAAGATGCTTTTCTGTGACTGGTGAGTACTCAACCAAGTCATTCTGAGA

ATAGTGTATGCGGCGACCGAGTTGCTCTTGCCCGGCGTCAATACGGGATAATACCGC

GCCACATAGCAGAACTTTAAAAGTGCTCATCATTGGAAAACGTTCTTCGGGGCGAA

AACTCTCAAGGATCTTACCGCTGTTGAGATCCAGTTCGATGTAACCCACTCGTGCAC

CCAACTGATCTTCAGCATCTTTTACTTTCACCAGCGTTTCTGGGTGAGCAAAAACAG

GAAGGCAAAATGCCGCAAAAAAGGGAATAAGGGCGACACGGAAATGTTGAATACT

CATACTCTTCCTTTTTCAATATTATTGAAGCATTTATCAGGGTTATTGTCTCATGAGC

GGATACATATTTGAATGTATTTAGAAAAATAAACAAATAGGGGTTCCGCGCACATTT

CCCCGAAAAGTGCCACCTGACGTC.
```

In particular embodiments, the heavy and light chain coding sequence are cloned into the NheI and EcoRI cut vector backbone. In certain case when the expressed antibody is histidine-tagged, the following coding sequence is appended to the 3' end of the last codon of the heavy chain constant region: -CAC CAT CAC CAT CAC CAT CAC CAT (SEQ ID NO: 60)-Stop codon.

The invention also provides host cells comprising a nucleic acid or a vector of the present invention. Any of a variety of host cells can be used. In one embodiment, a host cell is a prokaryotic cell, for example, E. coli. In another embodiment, a host cell is a eukaryotic cell, for example, a mammalian cell, such as a Chinese Hamster Ovary (CHO) cell, COS cells, BHK cells, NSO cells or Bowes melanoma cells. Examples of human host cells are, inter alia, HeLa, 911, AT1080, A549, 293 and HEK293T cells.

The present invention includes methods of producing antibodies and antigen-binding fragments thereof. In certain embodiments, they are produced recombinantly or by chemical synthesis. For example, antibodies and fragments thereof may be produced synthetically or by enzymatic or chemical cleavage of intact immunoglobulins or they may be genetically engineered by recombinant DNA techniques. Such methods of production are well known in the art and are described, for example, in Antibodies: A Laboratory Manual, edited by E. Harlow and D. Lane (1988), Cold Spring Harbor Laboratory, Cold Spring Harbor, N.Y., which is incorporated herein by reference. The antibodies and antigen-binding fragments may be produced synthetically or by enzymatic or chemical cleavage of intact immunoglobulins or they may be genetically engineered by recombinant DNA techniques. Illustrative methods of production are well known in the art and are described, for example, in Antibodies: A Laboratory Manual, edited by E. Harlow and D. Lane (1988), Cold Spring Harbor Laboratory, Cold Spring Harbor, N.Y. Various techniques have been developed for the production of antibody fragments. Traditionally, these fragments were derived via proteolytic digestion of intact antibodies (see, e.g., Morimoto et al., Journal of Biochemical and Biophysical Methods 24: 107-117 (1992); and Brennan et al., Science, 229:81 (1985)). However, these fragments can now be produced directly by recombinant host cells. Fab, Fv and scFv antibody fragments can all be expressed in and secreted from E. coli, thus allowing the facile production of large amounts of these fragments. Fab'-SH fragments can be directly recovered from E. coli and chemically coupled to form F(ab')$_2$ fragments (Carter et al., Bio/Technology 10: 163-167 (1992)). According to another approach, F(ab')$_2$ fragments can be isolated directly from recombinant host cell culture. Fab and F(ab')$_2$ fragment with increased in vivo half-life comprising a salvage receptor binding epitope residues are described in U.S. Pat. No. 5,869,046. Other techniques for the production of antibodies and antibody fragments will be apparent to the skilled practitioner.

In one embodiment, an antibody or antigen-binding fragment thereof is produced by isolating the antibody or antigen-binding fragment thereof from a host cell comprising an expression vector that encodes the antibody or antigen-binding fragment thereof. In certain embodiments, the method further comprises culturing the host cell under conditions suitable for expression of the antibody or antigen-binding fragment thereof and/or further comprises introducing an expression vector encoding the antibody or antigen-binding fragment thereof into the host cell.

Pharmaceutical Compositions

The present invention also includes pharmaceutical compositions comprising an antibody or antigen-binding fragment thereof described herein, or a polynucleotide encoding an antibody or antigen-binding fragment thereof described herein, and a pharmaceutically acceptable diluent, carrier or excipient. In certain embodiments, the pharmaceutical composition comprises a therapeutically effective amount of the antibody, antigen-binding fragment thereof, or polynucleotide.

Various pharmaceutically acceptable diluents, carriers, and excipients, and techniques for the preparation and use of pharmaceutical compositions will be known to those of skill in the art in light of the present disclosure. Illustrative pharmaceutical compositions and pharmaceutically acceptable diluents, carriers, and excipients are also described in Remington: The Science and Practice of Pharmacy 20th Ed. (Lippincott, Williams & Wilkins 2003). In particular embodiments, each carrier, diluent or excipient is "acceptable" in the sense of being compatible with the other ingredients of the pharmaceutical composition and not injurious to the subject. Often, the pharmaceutically acceptable carrier is an aqueous pH-buffered solution. Some examples of materials which can serve as pharmaceutically-acceptable carriers, diluents or excipients include: water; buffers, e.g., phosphate-buffered saline; sugars, such as lactose, glucose and sucrose; starches, such as corn starch and potato starch; cellulose, and its derivatives, such as sodium carboxymethyl cellulose, ethyl cellulose and cellulose acetate; powdered tragacanth; malt; gelatin; talc; excipients, such as cocoa butter and suppository waxes; oils, such as peanut oil, cottonseed oil, safflower oil, sesame oil, olive oil, corn oil and soybean oil; glycols, such as propylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; phosphate buffer solutions; and other non-toxic compatible substances employed in pharmaceutical formulations. Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the compositions.

In certain embodiments, pharmaceutical compositions are sterile. In certain embodiments, the pharmaceutical composition has a pH in the range of 4.5 to 8.5, 4.5 to 6.5, 6.5 to 8.5, or a pH of about 5.0, about 5.5, about 6.0, about 6.5, about 7.0, about 7.5, about 8.0 or about 8.5. In one embodiment, the pharmaceutical composition has an osmolarity in the range of 240-260 or 250-330 mOsmol/L. In certain embodiments, the pharmaceutical composition is isotonic or near isotonic. In certain embodiments, the pharmaceutical composition is formulated for intravenous administration and has a concentration of antibody or fragment thereof of 10-100 mg/ml, 10-50 mg/ml, 20 to 40 mg/ml, or about 30 mg/ml. In certain embodiments, the pharmaceutical composition is formulated for subcutaneous injection and has a concentration of antibody or fragment thereof of 50-500 mg/ml, 50-250 mg/ml, or 100 to 150 mg/ml, and a viscosity less than 50 cP, less than 30 cP, less than 20 cP, or about 10 cP. In particular embodiments, the pharmaceutical compositions are liquids or solids. In particular embodiments, the pharmaceutical compositions are formulated for parenteral, e.g., intravenous, subcutaneous, or oral administration.

The formulation of and delivery methods of pharmaceutical compositions will generally be adapted according to the site and the disease to be treated. Exemplary formulations include, but are not limited to, those suitable for parenteral administration, e.g., intravenous, intra-arterial, intramuscular, or subcutaneous administration, including formulations encapsulated in micelles, liposomes or drug-release capsules (active agents incorporated within a biocompatible coating designed for slow-release); ingestible formulations; formulations for topical use, such as creams, ointments and gels; and other formulations such as inhalants, aerosols and sprays.

Methods of Use

The present invention provides methods for treating and preventing an HIV infection or a related disease or disorder in a subject in need thereof, comprising providing to a subject in need thereof an effective amount of an antibody or antigen-binding fragment thereof described herein, or a polynucleotide encoding the antibody or antigen-binding fragment thereof. The polynucleotide may be present in a vector, e.g., a viral vector. In particular embodiments, the related disease or disorder is caused by infection with HIV. In particular embodiments, it is acquired immune deficiency syndrome (AIDS). In particular embodiments, the subject is a virologically suppressed HIV-infected mammal, while is other embodiments, the subject is a treatment-naïve HIV-infected mammal. In certain embodiments, a treatment-naïve subject has a viral load between $10^3$ and $10^5$ copies/ml, and in certain embodiments, a virologically suppressed subject has a viral load<50 copies/ml. In particular embodiments, the subject is a mammal, e.g., a human. In certain embodiments, the subject has been diagnosed with an HIV, e.g., HIV-1 or HIV-2, infection or a related disease or disorder, e.g., AIDS, or is considered at risk for developing an HIV, e.g., HIV-1 or HIV-2, infection or a related disease or disorder, e.g., AIDS. Subjects at risk for HIV-related diseases or disorders include patients who have come into contact with an infected person or who have been exposed to HIV in some other way. Administration of a prophylactic agent can occur prior to the manifestation of symptoms characteristic of HIV-related disease or disorder, such that a disease or disorder is prevented or, alternatively, delayed in its progression.

The present invention further provides methods for preventing or inhibiting an increase in HIV virus titer, virus replication, virus proliferation or an amount of an HIV viral DNA, HIV proviral DNA, or HIV viral protein in a subject. In one embodiment, the method comprises providing to the subject in need thereof an amount of an antibody or antigen-binding fragment thereof described herein, or a polynucleotide encoding the antibody or antigen-binding fragment thereof, effective to prevent an increase in HIV titer, virus replication or an amount of an HIV protein of one or more HIV strains or isolates in the subject. In certain embodiments, the method further comprises measuring an amount of HIV viral or proviral DNA or protein at one or more time points, e.g., before and after the subject in provided with an antibody or antibody-binding fragment of the present invention. Methods and biomarkers for determining an amount of HIV viral or proviral DNA or protein in a subject are known and available in the art, and described for example, in Siliciano, J. D. et al., Curr Opin. HIV AIDS (2010) 5(6): 491-7 and Rouzioux, C. et al., Curr Opin HIV AIDS (2013) 8(3):170-5, each of which are incorporated by reference in its entirety.

In certain aspect, the antibodies of the present disclosure may be used in, for example, methods of inhibiting certain viruses such as HIV isolates described herein, prophylactic inhibiting or preventing infections of certain viruses such as HIV isolates described herein, detection of certain viruses such as HIV isolates described herein in a sample, inhibiting certain viruses such as HIV isolates described herein, diagnosis of certain viruses such as HIV isolates described herein.

For in vivo treatment of mammalian subject, e.g., humans, the subject may be administered or provided a pharmaceutical composition comprising the antibody or antigen-binding fragment thereof of the invention. When used for in vivo therapy, the antibodies and antigen-binding fragments thereof of the invention are typically administered or provided to the patient in therapeutically effective amounts (i.e., amounts that eliminate or reduce the patient's viral burden and/or viral reservoir). The antibodies or antigen-binding fragments thereof are administered or provided to a mammalian subject, e.g., a human, in accord with known methods, such as, but not limited to, intravenous administration, e.g., as a bolus or by continuous infusion over a period of time, by intramuscular, intraperitoneal, intracerobrospinal, subcutaneous, intraarticular, intrasynovial, intrathecal, oral, topical, or inhalation routes. The antibodies or antigen-binding fragments thereof may be administered parenterally, when possible, at the target cell site, or intravenously. Intravenous or subcutaneous administration of the antibody or antigen-binding fragment thereof is preferred in certain embodiments. In particular embodiments, pharmaceutical compositions of the invention are administered to a patient or subject systemically, parenterally, or locally.

In particular embodiments, for parenteral administration, the antibodies or antigen-binding fragments thereof are formulated in a unit dosage injectable form (solution, suspension, emulsion) in association with a pharmaceutically acceptable, parenteral vehicle. Examples of such vehicles are water, saline, Ringer's solution, dextrose solution, and 5% human serum albumin. Nonaqueous vehicles such as fixed oils and ethyl oleate may also be used. Liposomes may be used as carriers. The vehicle may contain minor amounts of additives such as substances that enhance isotonicity and chemical stability, e.g., buffers and preservatives. In certain embodiments, the antibodies or antigen-binding fragments thereof are formulated in such vehicles at concentrations of about 1 mg/ml to about 200 mg/ml, about 1 mg/ml to about 100 mg/ml, about 1 mg/ml to about 50 mg/ml, about 1 mg/ml to about 25 mg/ml, about 1 mg/ml to about 10 mg/ml, e.g., about 1 mg/ml, about 2 mg/ml, about 3 mg/ml, about 4 mg/ml, about 5 mg/ml, about 6 mg/ml, about 7 mg/ml, about 8 mg/ml, about 9 mg/ml, about 10 mg/ml about 25 mg/ml, about 50 mg/ml, about 100 mg/ml, about 150 mg/ml, or about 200 mg/ml.

The dose and dosage regimen depends upon a variety of factors readily determined by a physician, such as the nature of the infection, the characteristics of the subject, and the subject's history. In particular embodiments, the amount of antibody or antigen-binding fragment thereof administered or provided to the subject is in the range of about 0.1 mg/kg to about 50 mg/kg of the subject's body weight. Depending on the type and severity of the infection, in certain embodiments, about 0.1 mg/kg to about 50 mg/kg body weight (e.g., about 0.1-15 mg/kg/dose) of antibody or antigen-binding fragment thereof may be provided as an initial candidate dosage to the patient, whether, for example, by one or more separate administrations, or by continuous infusion. The progress of the therapy is readily monitored by conventional methods and assays and based on criteria known to the physician or other persons of skill in the art.

In particular embodiments, an antibody or fragment thereof of the present invention may be provided to a subject in an amount sufficient to achieve a $C_{trough}$ level of ≤0.1 µg/mL, ≤0.5 µg/ml, ≤1 µg/ml, ≤10 µg/ml, ≤20 µg/ml, ≤30 µg/ml, ≤40 µg/ml, ≤50 µg/ml, ≤75 µg/ml, ≤100 µg/ml, ≤200 µg/ml, ≤300 µg/ml, or <500 µg/mL. In certain embodiments, an antibody or fragment thereof of the present invention may be provided to a subject in an amount sufficient to achieve a $C_{trough}$ level of 1 µg/ml to 100 µg/ml. In particular embodiments, an antibody or fragment thereof of the present invention may be provided to a subject in an amount sufficient to achieve a $C_{max}$ level of ≥1 µg/ml, ≥5 µg/ml, ≥10 µg/ml, ≥50 µg/ml, ≥100 µg/ml, ≥200 µg/ml, ≥300 µg/ml, ≥400 µg/ml, ≥500 µg/ml, or ≥1000 µg/mL. In certain embodiments, an antibody or fragment thereof of the present invention may be provided to a subject in an amount sufficient to achieve a $C_{max}$ level of 100 µg/ml to 1000 µg/ml.

In certain embodiments, the antibody or antigen-binding fragment thereof of the present invention is provided to the subject in combination with one or more additional therapeutic agent used to treat HIV infection or a related disease or disorder. In certain embodiments, a method for treating or preventing an HIV infection in a mammal, e.g., a human, having or at risk of having the infection is provided, comprising administering to the human a therapeutically effective amount of an antibody or fragment thereof disclosed herein, or a pharmaceutically acceptable salt thereof, in combination with a therapeutically effective amount of one or more (e.g., one, two, three, one or two, or one to three) additional therapeutic agents. In one embodiment, a method for treating an HIV infection in a human having or at risk of having the infection is provided, comprising administering to the human a therapeutically effective amount of an antibody or fragment thereof disclosed herein, or a pharmaceutically acceptable salt thereof, in combination with a therapeutically effective amount of one or more (e.g., one, two, three, one or two, or one to three) additional therapeutic agents.

In certain embodiments, the present disclosure provides a method for treating an HIV infection, comprising administering to a patient in need thereof a therapeutically effective amount of an antibody or fragment thereof disclosed herein, or a pharmaceutically acceptable salt thereof, in combination with a therapeutically effective amount of one or more additional therapeutic agents which are suitable for treating an HIV infection.

In certain embodiments, two or more antibodies or fragments thereof disclosed herein, or pharmaceutically acceptable salts thereof, may be provided to the subject. In particular embodiments, the two or more antibodies or fragments thereof may have different specificities, e.g., each may preferentially bind, inhibit, or neutralize a different HIV strain or combination of strains, as compared to each other. In certain embodiments, the antibodies may comprise any of the following: PGT-121 LO6 or one of its variants including somatic variants PGT122, PGT123, PGT124, 10-1074, PGT133, or PGT134 (or any of the variants described herein); PGT145 or one of its variants; PG16 or one of its variants, PG9 or one of its variants; PGT151 or one of its variants; or any other combination of bNAbs that provide complementary binding, neutralization or infected cell killing activity. In particular embodiments, the HIV strains are Clade B strains.

An antibody or fragment thereof disclosed herein may be combined with one or more additional therapeutic agents in any dosage amount of the antibody or fragment thereof (e.g., from 50 mg to 1000 mg of compound). Also, an antibody or fragment thereof disclosed herein may be combined with one or more additional therapeutic agents in any dosage amount of the antibody or fragment thereof (e.g., about 0.1 mg/kg to about 50 mg/kg of the subject's body weight or from 50 mg to 4000 mg of compound).

In one embodiment, pharmaceutical compositions comprising an antibody or fragment thereof disclosed herein, or a pharmaceutically acceptable salt thereof, in combination with one or more (e.g., one, two, three, one or two, or one to three) additional therapeutic agents, and a pharmaceutically acceptable carrier, diluent or excipient are provided.

In one embodiment, kits comprising an antibody or fragment thereof disclosed herein, or a pharmaceutically acceptable salt thereof, in combination with one or more (e.g., one, two, three, one or two, or one to three) additional therapeutic agents are provided.

In the above embodiments, the additional therapeutic agent may be an anti-HIV agent. For example, in some embodiments, the additional therapeutic agent is selected from the group consisting of HIV protease inhibitors, HIV non-nucleoside or non-nucleotide inhibitors of reverse transcriptase, HIV nucleoside or nucleotide inhibitors of reverse transcriptase, HIV integrase inhibitors, HIV non-catalytic site (or allosteric) integrase inhibitors, HIV entry inhibitors (e.g., CCR5 inhibitors, gp41 inhibitors (i.e., fusion inhibitors) and CD4 attachment inhibitors), CXCR4 inhibitors, gp120 inhibitors, G6PD and NADH-oxidase inhibitors, HIV vaccines, HIV maturation inhibitors, latency reversing agents (e.g., histone deacetylase inhibitors, proteasome inhibitors, protein kinase C (PKC) activators, and BRD4 inhibitors), compounds that target the HIV capsid ("capsid inhibitors"; e.g., capsid polymerization inhibitors or capsid disrupting compounds, HIV nucleocapsid p7 (NCp7) inhibitors, HIV p24 capsid protein inhibitors), pharmacokinetic enhancers, immune-based therapies (e.g., Pd-1 modulators, Pd-L1 modulators, toll like receptors modulators, IL-15 agonists), HIV antibodies, bispecific antibodies and "antibody-like" therapeutic proteins (e.g., dual-affinity re-targeting antibodies (DARTs®), bi-specific antibodies with two different arms that bind to two different targets or different epitopes on the same target (DUOBODIES®), bi-specific T-cell engagers (BITES®), antibodies with enhanced Fc domains (XMABS®), Tetravalent Bispecific Tandem Antibodies (TANDABS®), Fab derivatives) including those targeting HIV gp120 or gp41, combination drugs for HIV, HIV p17 matrix protein inhibitors, IL-13 antagonists, Peptidyl-prolyl cis-trans isomerase A modulators, Protein disulfide isomerase inhibitors, Complement C5a receptor antagonists, DNA methyltransferase inhibitor, HIV vif gene modulators, Vif dimerization antagonists, HIV-1 viral infectivity factor inhibitors, TAT protein inhibitors, HIV-1 Nef modulators, Hck tyrosine kinase modulators, mixed lineage kinase-3 (MLK-3) inhibitors, HIV-1 splicing inhibitors, Rev protein inhibitors, Integrin antagonists, Nucleoprotein inhibitors, Splicing factor modulators, COMM domain containing protein 1 modulators, HIV Ribonuclease H inhibitors, Retrocyclin modulators, CDK-9 inhibitors, Dendritic ICAM-3 grabbing nonintegrin 1 inhibitors, HIV GAG protein inhibitors, HIV POL protein inhibitors, Complement Factor H modulators, Ubiquitin ligase inhibitors, Deoxycytidine kinase inhibitors, Cyclin dependent kinase inhibitors Proprotein convertase PC9 stimulators, ATP dependent RNA helicase DDX3X inhibitors, reverse transcriptase priming complex inhibitors, HIV gene therapy, PI3K inhibitors, compounds such as those disclosed in WO 2013/006738 (Gilead Sciences), US 2013/0165489 (University of Pennsylvania), WO 2013/091096A1 (Boehringer Ingelheim), WO 2009/062285 (Boehringer Ingelheim), US20140221380 (Japan Tobacco), US20140221378 (Japan Tobacco), WO 2010/130034 (Boehringer Ingelheim), WO 2013/159064 (Gilead Sciences), WO 2012/145728 (Gilead Sciences), WO2012/003497 (Gilead Sciences), WO2014/100323 (Gilead Sciences), WO2012/145728 (Gilead Sciences), WO2013/159064 (Gilead Sciences) and WO 2012/003498 (Gilead Sciences) and WO 2013/006792 (Pharma Resources), and other drugs for treating HIV, and combinations thereof.

In certain embodiments, the additional therapeutic is selected from the group consisting of HIV protease inhibitors, HIV non-nucleoside or non-nucleotide inhibitors of reverse transcriptase, HIV nucleoside or nucleotide inhibitors of reverse transcriptase, HIV integrase inhibitors, HIV non-catalytic site (or allosteric) integrase inhibitors, pharmacokinetic enhancers, and combinations thereof.

In particular embodiments, the additional therapeutic agent is a latency reversing agent (LRA), e.g., a TLR7 agonist. In other embodiments, the additional therapeutic agent is a latency reversing agent (LRA), e.g., a TLR8 agonist. Examples of TLR agonists include but are not limited to Vesatolimod. Additional examples include but are not limited to the compounds described in U.S. Pat. No. 8,367,670 and the compounds described in U.S. Patent Application Publication No. 2016-0289229. In one embodiment, the antibody of the present invention may be combined with TLR7 agonist such as Vesatolimod. In another embodiment, the antibody of the present invention may be combined with TLR8 agonist. In one embodiment, the additional therapeutic agent is a TLR modulator. TLR modulators may include modulators of TLR1, TLR2, TLR3, TLR4, TLR5, TLR6, TLR7, TLR8, TLR9, TLR10, TLR11, TLR12, and TLR13. Examples of TLR3 modulators include rintatolimod, poly-ICLC, RIBOXXON®, Apoxxim, RIBOXXIM®, IPH-33, MCT-465, MCT-475, and ND-1.1. Examples of TLR7 modulators include GS-9620, GSK-2245035, imiquimod, resiquimod, DSR-6434, DSP-3025, IMO-4200, MCT-465, MEDI-9197, 3M-051, SB-9922, 3M-052, Limtop, TMX-30X, TMX-202, RG-7863, RG-7795, and the compounds disclosed in US20100143301 (Gilead Sciences), US20110098248 (Gilead Sciences), and US20090047249 (Gilead Sciences). Examples of TLR8 modulators include motolimod, resiquimod, 3M-051, 3M-052, MCT-465, IMO-4200, VTX-763, VTX-1463, and the compounds disclosed in US20140045849 (Janssen), US20140073642 (Janssen), WO2014/056953 (Janssen), WO2014/076221 (Janssen), WO2014/128189 (Janssen), US20140350031 (Janssen), WO2014/023813 (Janssen), US20080234251 (Array Biopharma), US20080306050 (Array Biopharma), US20100029585 (Ventirx Pharma), US20110092485 (Ventirx Pharma), US20110118235 (Ventirx Pharma), US20120082658 (Ventirx Pharma), US20120219615 (Ventirx Pharma), US20140066432 (Ventirx Pharma), US20140088085 (Ventirx Pharma), US20140275167 (Novira Therapeutics), and US20130251673 (Novira Therapeutics). Examples of TLR9 modulators include BB-001, BB-006, CYT-003, IMO-2055, IMO-2125, IMO-3100, IMO-8400, IR-103, IMO-9200, agatolimod, DIMS-9054, DV-1079, DV-1179, AZD-1419, leftolimod (MGN-1703), litenimod, and CYT-003-QbG10.

Without wishing to be bound by any particular theory, it is believed that LRAs may increase cell surface Env expression, thus enhancing latent cell killing via effector function enhanced by the antibodies of the present invention. In certain embodiments, the additional therapeutic agents comprise one or more antiretroviral therapies (ARTs). In particular embodiments, the ART is a combination ART (cART) such as highly active ART (HAART). In particular embodiments, the ART comprises one or more of a nucleoside reverse transcriptase inhibitor (NRTI), a non-nucleoside reverse transcriptase inhibitor (NNRTI), a protease inhibitor (PI), an entry inhibitor, or an HIV integrase inhibitor. Examples of NRTIs include but are not limited to: Zidovudine (Retrovir, AZT); Didanosine (Videx, Videx EC, ddI); Stavudine (Zerit, d4T); Lamivudine (Epivir, 3TC); Tenofovir, a nucleotide analog (Viread, TDF); Combivir (combination of zidovudine and lamivudine); Trizivir (combination of zidovudine, lamivudine and abacavir); Emtricitabine (Emtriva, FTC); Truvada (combination of emtricitabine and tenofovir); and Epzicom (combination of abacavir and lamivudine). Examples of NNRTIs include but are not limited to: Nevirapine (Viramune, NVP); Delavirdine (Rescriptor, DLV); Efavirenz (Sustiva or Stocrin, EFV, also part of Atripla); Etravirine (Intelence, ETR); and Rilpivirine (Edurant, RPV, also part of Complera or Epivlera). Examples of PIs include but are not limited to: Saquinavir (Invirase, SQV); Indinavir (Crixivan, IDV); Ritonavir (Norvir, RTV); Nelfinavir (Viracept, NFV); Amprenavir (Agenerase, APV); Lopinavir/ritonavir (Kaletra or Aluvia, LPV/RTV); Atazanavir (Reyataz, ATZ); Fosamprenavir (Lexiva, Telzir, FPV); Tipranavir (Aptivus, TPV); and Darunavir (Prezista, DRV). Examples of entry inhibitors include but are not limited to: Enfuvirtide (Fuzeon, ENF, T-20) and Maraviroc (Selzentry or Celsentri, MVC). Examples of HIV integras inhibitors include but are not limited to: Raltegravir (Isentress, RAL); Elvitegravir (EVG, part of the combination Stribild) and Dolutegravir (Tivicay, DTG).

In certain embodiments an antibody or fragment thereof disclosed herein is formulated as a tablet, which may optionally contain one or more other compounds useful for treating HIV. In certain embodiments, the tablet can contain another active ingredient for treating HIV, such as HIV protease inhibitors, HIV non-nucleoside or non-nucleotide inhibitors of reverse transcriptase, HIV nucleoside or nucleotide inhibitors of reverse transcriptase, HIV integrase inhibitors, HIV non-catalytic site (or allosteric) integrase inhibitors, pharmacokinetic enhancers, and combinations thereof.

In certain embodiments, such tablets are suitable for once daily dosing. In certain embodiments, the additional therapeutic agent is selected from one or more of:

(1) Combination drugs selected from the group consisting of ATRIPLA® (efavirenz+tenofovir disoproxil fumarate+emtricitabine), COMPLERA® (EVIPLERA®, rilpivirine+tenofovir disoproxil fumarate+emtricitabine), STRIBILD® (elvitegravir+cobicistat+tenofovir disoproxil fumarate+emtricitabine), dolutegravir+abacavir sulfate+lamivudine, TRIUMEQ® (dolutegravir+abacavir+lamivudine), lamivudine+nevirapine+zidovudine, dolutegravir+rilpivirine, dolutegravir+rilpivirine hydrochloride, atazanavir sulfate+cobicistat, atazanavir+cobicistat, darunavir+cobicistat, efavirenz+lamivudine+tenofovir disoproxil fumarate, tenofovir alafenamide hemifumarate+emtricitabine+cobicistat+elvitegravir, tenofovir alafenamide hemifumarate+emtricitabine, tenofovir alafenamide+emtricitabine, tenofovir alafenamide hemifumarate+emtricitabine+rilpivirine, tenofovir alafenamide+emtricitabine+rilpivirine, Vacc-4x+romidepsin, darunavir+tenofovir alafenamide hemifumarate+emtricitabine+cobicistat, APH-0812, raltegravir+lamivudine, KALETRA® (ALUVIA®, lopinavir+ritonavir), atazanavir sulfate+ritonavir, COMBIVIR® (zidovudine+lamivudine, AZT+3TC), EPZICOM® (Livexa®, abacavir sulfate+lamivudine, ABC+3TC), TRIZIVIR® (abacavir sulfate+zidovudine+lamivudine, ABC+AZT+3TC), TRUVADA® (tenofovir disoproxil fumarate+emtricitabine, TDF+FTC), doravirine+lamivudine+tenofovir disoproxil fumarate, doravirine+lamivudine+tenofovir disoproxil, tenofovir+lamivudine and lamivudine+tenofovir disoproxil fumarate;

(2) HIV protease inhibitors selected from the group consisting of amprenavir, atazanavir, fosamprenavir, fosamprenavir calcium, indinavir, indinavir sulfate, lopinavir, ritonavir, nelfinavir, nelfinavir mesylate, saquinavir, saquinavir mesylate, tipranavir, brecanavir, darunavir, DG-17, TMB-657 (PPL-100) and TMC-310911;

(3) HIV non-nucleoside or non-nucleotide inhibitors of reverse transcriptase selected from the group consisting of delavirdine, delavirdine mesylate, nevirapine, etravirine, dapivirine, doravirine, rilpivirine, efavirenz, KM-023, VM-1500, lentinan and AIC-292;

(4) HIV nucleoside or nucleotide inhibitors of reverse transcriptase selected from the group consisting of VIDEX® (didanosine) and VIDEX® EC (extended-release didanosine, ddI), zidovudine, emtricitabine, didanosine, stavudine, zalcitabine, lamivudine, censavudine, abacavir, abacavir sulfate, elvucitabine, alovudine, phosphazid, fozivudine tidoxil, apricitabine, KP-1461, fosalvudine tidoxil, tenofovir, tenofovir disoproxil, tenofovir disoproxil fumarate, tenofovir disoproxil hemifumarate, tenofovir alafenamide, tenofovir alafenamide hemifumarate, tenofovir alafenamide fumarate, adefovir, adefovir dipivoxil, and festinavir;

(5) HIV integrase inhibitors selected from the group consisting of curcumin, derivatives of curcumin, chicoric acid, derivatives of chicoric acid, 3,5-dicaffeoylquinic acid, derivatives of 3,5-dicaffeoylquinic acid, aurintricarboxylic acid, derivatives of aurintricarboxylic acid, caffeic acid phenethyl ester, derivatives of caffeic acid phenethyl ester, tyrphostin, derivatives of tyrphostin, quercetin, derivatives of quercetin, raltegravir, elvitegravir, dolutegravir and cabotegravir;

(6) HIV non-catalytic site, or allosteric, integrase inhibitors (NCINI) selected from the group consisting of CX-05168, CX-05045 and CX-14442;

(7) HIV gp41 inhibitors selected from the group consisting of enfuvirtide, sifuvirtide and albuvirtide;

(8) HIV entry inhibitors selected from the group consisting of cenicriviroc;

(9) HIV gp120 inhibitors selected from the group consisting of Radha-108 (Receptol) and BMS-663068;

(10) CCR5 inhibitors selected from the group consisting of aplaviroc, vicriviroc, maraviroc, cenicriviroc, PRO-140, Adaptavir (RAP-101), nifeviroc (TD-0232), TD-0680, and vMIP (Haimipu);

(11) CD4 attachment inhibitors, e.g., Fostemsavir (BMS-663068);

(12) inhibitors of post-binding events required for entry selected from the group consisting of ibalizumab;

(12) CXCR4 inhibitors selected from the group consisting of plerixafor, ALT-1188, vMIP and Haimipu;

(13) Pharmacokinetic enhancers selected from the group consisting of cobicistat and ritonavir;

(14) Immune-based therapies selected from the group consisting of dermaVir, interleukin-7, plaquenil (hydroxychloroquine), proleukin (aldesleukin, IL-2), interferon alfa, interferon alfa-2b, interferon alfa-n3, pegylated interferon alfa, interferon gamma, hydroxyurea, mycophenolate mofetil (MPA) and its ester derivative mycophenolate mofetil (MMF), WF-10, ribavirin, IL-2, IL-12, polymer polyethyleneimine (PEI), Gepon, VGV-1, MOR-22, BMS-936559, toll-like receptors modulators (TLR1, TLR2, TLR3, TLR4, TLR5, TLR6, TLR7, TLR8, TLR9, TLR10, TLR11, TLR12 and TLR13), rintatolimod and IR-103;

(15) HIV vaccines selected from the group consisting of peptide vaccines, recombinant subunit protein vaccines, live vector vaccines, DNA vaccines, virus-like particle vaccines (pseudovirion vaccine), CD4-derived peptide vaccines, vaccine combinations, rgp120 (AIDSVAX), ALVAC HIV (vCP1521)/AIDSVAX B/E (gp120) (RV144), monomeric gp120 HIV-1 subtype C vaccine (Novartis), Remune, ITV-1, Contre Vir, Ad5-ENVA-48, DCVax-001 (CDX-2401), PEP-6409, Vacc-4x, Vacc-05, VAC-3S, multiclade DNA recombinant adenovirus-5 (rAd5), Pennvax-G, VRC-HIV MAB060-00-AB, AVX-101, AVX-201, HIV-LAMP-vax, Ad35, Ad35-GRIN, NAcGM3/VSSP ISA-51, poly-ICLC adjuvanted vaccines, TatImmune, GTU-multiHIV (FIT-06), AGS-004, gp140[delta]V2.TV1+MF-59, rVSVIN HIV-1 gag vaccine, SeV-Gag vaccine, AT-20, DNK-4, Ad35-GRIN/ENV, TBC-M4, HIVAX, HIVAX-2, NYVAC-HIV-PT1, NYVAC-HIV-PT4, DNA-HIV-PT123, rAAV1-PG9DP, GOVX-B11, GOVX-B21, ThV-01, TUTI-16, VGX-3300, TVI-HIV-1, Ad-4 (Ad4-env Clade C+Ad4-mGag), EN41-UGR7C, EN41-FPA2, PreVaxTat, TL-01, SAV-001, AE-H, MYM-V101, CombiHIVvac, ADVAX, MYM-V201, MVA-CMDR, MVATG-17401, ETV-01, CDX-1401, rcAd26.MOS1.HIV-Env and DNA-Ad5 gag/pol/nef/nev (HVTN505);

(16) HIV antibodies, bispecific antibodies and "antibody-like" therapeutic proteins (such as dual-affinity re-targeting antibodies (DARTs®), bi-specific antibodies with two different arms that bind to two different targets or different epitopes on the same target (DUOBODIES®), bi-specific T-cell engagers (BITES®), antibodies with enhanced Fc domains (XMABS®), Tetravalent Bispecific Tandem Antibodies (TANDABS®), Fab derivatives) including BMS-936559, TMB-360 and those targeting HIV gp120 or gp41 selected from the group consisting of bavituximab, UB-421, C2F5, C2G12, C4E10, C2F5+C2G12+C4E10, 3-BNC-117, PGT145, PGT121, MDX010 (ipilimumab), VRC01, A32, 7B2, 10E8, VRC-07-523 and VRC07;

(17) latency reversing agents selected from the group consisting of Histone deacetylase inhibitors such as Romidepsin, vorinostat, panobinostat; Proteasome inhibitors such as Velcade; protein kinase C (PKC) activators such as Indolactam, Prostratin, Ingenol B and DAG-lactones, Ionomycin, GSK-343, PMA, SAHA, BRD4 inhibitors, IL-15, JQ1, disulfram, and amphotericin B;

(18) HIV nucleocapsid p7 (NCp7) inhibitors selected from the group consisting of azodicarbonamide;

(19) HIV maturation inhibitors selected from the group consisting of BMS-955176 and GSK-2838232;

(20) PI3K inhibitors selected from the group consisting of idelalisib, AZD-8186, buparlisib, CLR-457, pictilisib, neratinib, rigosertib, rigosertib sodium, EN-3342, TGR-1202, alpelisib, duvelisib, UCB-5857, taselisib, XL-765, gedatolisib, VS-5584, copanlisib, CAI orotate, perifosine, RG-7666, GSK-2636771, DS-7423, panulisib, GSK-2269557, GSK-2126458, CUDC-907, PQR-309, INCB-040093, pilaralisib, BAY-1082439, puquitinib mesylate, SAR-245409, AMG-319, RP-6530, ZSTK-474, MLN-1117, SF-1126, RV-1729, sonolisib, LY-3023414, SAR-260301 and CLR-1401;

(21) the compounds disclosed in WO 2004/096286 (Gilead Sciences), WO 2006/110157 (Gilead Sciences), WO 2006/015261 (Gilead Sciences), WO 2013/006738 (Gilead Sciences), US 2013/0165489 (University of Pennsylvania), US20140221380 (Japan Tobacco), US20140221378 (Japan Tobacco), WO 2013/006792 (Pharma Resources), WO 2009/062285 (Boehringer Ingelheim), WO 2010/130034 (Boehringer Ingelheim), WO 2013/091096A1 (Boehringer Ingelheim), WO 2013/159064 (Gilead Sciences), WO 2012/145728 (Gilead Sciences), WO2012/003497 (Gilead Sciences), WO2014/100323 (Gilead Sciences), WO2012/145728 (Gilead Sciences), WO2013/159064 (Gilead Sciences) and WO 2012/003498 (Gilead Sciences); and

(22) other drugs for treating HIV selected from the group consisting of BanLec, MK-8507, AG-1105, TR-452, MK-8591, REP 9, CYT-107, alisporivir, NOV-205, IND-02, metenkefalin, PGN-007, Acemannan, Gamimune, Prolastin, 1,5-dicaffeoylquinic acid, BIT-225, RPI-MN, VSSP, Hlviral, IMO-3100, SB-728-T, RPI-MN, VIR-576, HGTV-43, MK-1376, rHIV7-shl-TAR-CCR5RZ, MazF gene therapy, BlockAide, ABX-464, SCY-635, naltrexone, AAV-eCD4-Ig gene therapy, TEV-90110, TEV-90112, deferiprone, and PA-1050040 (PA-040).

In certain embodiments, an antibody or fragment thereof disclosed herein, or a pharmaceutically acceptable salt thereof, is combined with one, two, three, four or more additional therapeutic agents. In certain embodiments, a compound disclosed herein, or a pharmaceutically acceptable salt thereof, is combined with two additional therapeutic agents. In other embodiments, a compound disclosed herein, or a pharmaceutically acceptable salt thereof, is combined with three additional therapeutic agents. In further embodiments, a compound disclosed herein, or a pharmaceutically acceptable salt thereof, is combined with four additional therapeutic agents. The one, two, three, four or more additional therapeutic agents can be different therapeutic agents selected from the same class of therapeutic agents, and/or they can be selected from different classes of therapeutic agents. In a specific embodiment, a compound disclosed herein, or a pharmaceutically acceptable salt thereof, is combined with an HIV nucleoside or nucleotide inhibitor of reverse transcriptase and an HIV non-nucleoside inhibitor of reverse transcriptase. In another specific embodiment, a compound disclosed herein, or a pharmaceutically acceptable salt thereof, is combined with an HIV nucleoside or nucleotide inhibitor of reverse transcriptase, and an HIV protease inhibiting compound. In a further embodiment, a compound disclosed herein, or a pharmaceutically acceptable salt thereof, is combined with an HIV nucleoside or nucleotide inhibitor of reverse transcriptase, an HIV non-nucleoside inhibitor of reverse transcriptase, and an HIV protease inhibiting compound. In an additional embodiment, a compound disclosed herein, or a pharmaceutically acceptable salt thereof, is combined with an HIV nucleoside or nucleotide inhibitor of reverse transcriptase, an HIV non-nucleoside inhibitor of reverse transcriptase, and a pharmacokinetic enhancer. In certain embodiments, a compound disclosed herein, or a pharmaceutically acceptable salt thereof, is combined with at least one HIV nucleoside inhibitor of reverse transcriptase, an integrase inhibitor, and a pharmacokinetic enhancer. In another embodiment, a compound disclosed herein, or a pharmaceutically acceptable salt thereof, is combined with two HIV nucleoside or nucleotide inhibitors of reverse transcriptase.

In a particular embodiment, a compound disclosed herein, or a pharmaceutically acceptable salt thereof, is combined with one, two, three, four or more additional therapeutic agents selected from Triumeq® (dolutegravir+abacavir+lamivudine), dolutegravir+abacavir sulfate+lamivudine, raltegravir, raltegravir+lamivudine, Truvada® (tenofovir disoproxil fumarate+emtricitabine, TDF+FTC), maraviroc, enfuvirtide, Epzicom® (Livexa®, abacavir sulfate+lamivudine, ABC+3TC), Trizivir® (abacavir sulfate+zidovudine+lamivudine, ABC+AZT+3TC), adefovir, adefovir dipivoxil, Stribild® (elvitegravir+cobicistat+tenofovir disoproxil fumarate+emtricitabine), rilpivirine, rilpivirine hydrochloride, Complera® (Eviplera®, rilpivirine+tenofovir disoproxil fumarate+emtricitabine), Cobicistat, atazanavir sulfate+cobicistat, atazanavir+cobicistat, darunavir+cobicistat, Atripla® (efavirenz+tenofovir disoproxil fumarate+emtricitabine), atazanavir, atazanavir_sulfate, dolutegravir, elvitegravir, Aluvia® (Kaletra®, lopinavir+ritonavir), ritonavir, emtricitabine, atazanavir_sulfate+ritonavir, darunavir, lamivudine, Prolastin, fosamprenavir, fosamprenavir calcium, efavirenz, Combivir® (zidovudine+lamivudine, AZT+3TC), etravirine, nelfinavir, nelfinavir mesylate, interferon, didanosine, stavudine, indinavir, indinavir sulfate, tenofovir+lamivudine, zidovudine, nevirapine, saquinavir, saquinavir mesylate, aldesleukin, zalcitabine, tipranavir, amprenavir, delavirdine, delavirdine mesylate, Radha-108 (Receptol), Hlviral, lamivudine+tenofovir disoproxil fumarate, efavirenz+lamivudine+tenofovir disoproxil fumarate, phosphazid, lamivudine+nevirapine+zidovudine, abacavir, abacavir sulfate, tenofovir, tenofovir disoproxil, tenofovir disoproxil fumarate, darunavir+cobicistat, atazanavir sulfate+cobicistat, atazanavir+cobicistat, tenofovir alafenamide and tenofovir alafenamide hemifumarate. In some embodiment, a compound disclosed herein, or a pharmaceutically acceptable salt thereof, is combined with one, two, three, four or more additional therapeutic agents selected from ATRIPLA® (efavirenz, tenofovir disoproxil fumarate, and emtricitabine); COMPLERA® (EVIPLERA®; rilpivirine, tenofovir di soproxil fumarate, and emtricitabine); STRIBILD® (elvitegravir, cobicistat, tenofovir disoproxil fumarate, and emtricitabine); TRUVADA® (tenofovir disoproxil fumarate and emtricitabine; TDF+FTC); DESCOVY® (tenofovir alafenamide and emtricitabine); ODEFSEY® (tenofovir alafenamide, emtricitabine, and rilpivirine); GENVOYA® (tenofovir alafenamide, emtricitabine, cobicistat, and elvitegravir); adefovir; adefovir dipivoxil; cobicistat; emtricitabine; tenofovir; tenofovir disoproxil; tenofovir disoproxil fumarate; tenofovir alafenamide; tenofovir alafenamide hemifumarate; TRIUMEQ® (dolutegravir, abacavir, and lamivudine); dolutegravir, abacavir sulfate, and lamivudine; raltegravir; raltegravir and lamivudine; maraviroc; enfuvirtide; ALUVIA® (KALETRA®; lopinavir and ritonavir); COMBIVIR® (zidovudine and lamivudine; AZT+3TC); EPZICOM® (LIVEXA®; abacavir sulfate and lamivudine; ABC+3TC); TRIZIVIR® (abacavir sulfate, zidovudine, and lamivudine; ABC+AZT+3TC); rilpivirine; rilpivirine hydrochloride; atazanavir sulfate and cobicistat; atazanavir and cobicistat; darunavir and cobicistat; atazanavir; atazanavir sulfate; dolutegravir; elvitegravir; ritonavir; atazanavir sulfate and ritonavir; darunavir; lamivudine; prolastin; fosamprenavir; fosamprenavir calcium efavirenz; etravirine; nelfinavir; nelfinavir mesylate; interferon; didanosine; stavudine; indinavir; indinavir sulfate; tenofovir and lamivudine; zidovudine; nevirapine; saquinavir; saquinavir mesylate; aldesleukin; zalcitabine; tipranavir; amprenavir; delavirdine; delavirdine mesylate; Radha-108 (receptol); lamivudine and tenofovir disoproxil fumarate; efavirenz, lamivudine, and tenofovir disoproxil fumarate; phosphazid; lamivudine, nevirapine, and zidovudine; abacavir; and abacavir sulfate. It will be appreciated by one of skill in the art that the additional therapeutic agents listed above may be included in more than one of the classes listed above. The particular classes are not intended to limit the functionality of those compounds listed in those classes.

In a particular embodiment, a compound disclosed herein, or a pharmaceutically acceptable salt thereof, is combined with abacavir sulfate, tenofovir, tenofovir disoproxil, tenofovir disoproxil fumarate, tenofovir disoproxil hemifumarate, tenofovir alafenamide or tenofovir alafenamide hemifumarate.

In a particular embodiment, a compound disclosed herein, or a pharmaceutically acceptable salt thereof, is combined with tenofovir, tenofovir disoproxil, tenofovir disoproxil fumarate, tenofovir alafenamide, or tenofovir alafenamide hemifumarate.

In a particular embodiment, a compound disclosed herein, or a pharmaceutically acceptable salt thereof, is combined with a first additional therapeutic agent selected from the group consisting of: abacavir sulfate, tenofovir, tenofovir disoproxil, tenofovir disoproxil fumarate, tenofovir alafenamide, and tenofovir alafenamide hemifumarate and a second additional therapeutic agent selected from the group consisting of emtricitabine and lamivudine.

In a particular embodiment, a compound disclosed herein, or a pharmaceutically acceptable salt thereof, is combined with a first additional therapeutic agent selected from the group consisting of: tenofovir, tenofovir disoproxil, tenofovir disoproxil fumarate, tenofovir alafenamide, and tenofovir alafenamide hemifumarate and a second additional therapeutic agent, wherein the second additional therapeutic agent is emtricitabine.

In certain embodiments, a compound disclosed herein, or a pharmaceutically acceptable salt thereof, is combined with 5-30 mg tenofovir alafenamide fumarate, tenofovir alafenamide hemifumarate, or tenofovir alafenamide and 200 mg emtricitabine. In certain embodiments, a compound disclosed herein, or a pharmaceutically acceptable salt thereof, is combined with 5-10; 5-15; 5-20; 5-25; 25-30; 20-30; 15-30; or 10-30 mg tenofovir alafenamide fumarate, tenofovir alafenamide hemifumarate, or tenofovir alafenamide and 200 mg emtricitabine. In certain embodiments, a compound disclosed herein, or a pharmaceutically acceptable salt thereof, is combined with 10 mg tenofovir alafenamide fumarate, tenofovir alafenamide hemifumarate, or tenofovir alafenamide and 200 mg emtricitabine. In certain embodiments, a compound disclosed herein, or a pharmaceutically acceptable salt thereof, is combined with 25 mg tenofovir alafenamide fumarate, tenofovir alafenamide hemifumarate, or tenofovir alafenamide and 200 mg emtricitabine. A compound as disclosed herein (e.g., a compound of formula (I)) may be combined with the agents provided herein in any dosage amount of the compound (e.g., from 50 mg to 500 mg of compound) the same as if each combination of dosages were specifically and individually listed. A compound as disclosed herein (e.g., a compound of formula (I)) may be combined with the agents provided herein in any dosage amount of the compound (e.g., from 1 mg to 500 mg of compound) the same as if each combination of dosages were specifically and individually listed.

In certain embodiments, a compound disclosed herein, or a pharmaceutically acceptable salt thereof, is combined with 200-400 mg tenofovir disoproxil fumarate, tenofovir disoproxil hemifumarate, or tenofovir disoproxil and 200 mg emtricitabine. In certain embodiments, a compound disclosed herein, or a pharmaceutically acceptable salt thereof, is combined with 200-250; 200-300; 200-350; 250-350;

250-400; 350-400; 300-400; or 250-400 mg tenofovir disoproxil fumarate, tenofovir disoproxil hemifumarate, or tenofovir disoproxil and 200 mg emtricitabine. In certain embodiments, a compound disclosed herein, or a pharmaceutically acceptable salt thereof, is combined with 300 mg tenofovir disoproxil fumarate, tenofovir disoproxil hemifumarate, or tenofovir disoproxil and 200 mg emtricitabine. An antibody or fragment thereof as disclosed herein may be combined with the agents provided herein in any dosage amount of the antibody or fragment thereof (e.g., from 50 mg to 500 mg of antibody or fragment thereof) the same as if each combination of dosages were specifically and individually listed. A compound as disclosed herein (e.g., a compound of formula (I)) may be combined with the agents provided herein in any dosage amount of the compound (e.g., from 1 mg to 500 mg of compound) the same as if each combination of dosages were specifically and individually listed.

In certain embodiments, when an antibody or fragment thereof disclosed herein is combined with one or more additional therapeutic agents as described above, the components of the composition are administered as a simultaneous or sequential regimen. When administered sequentially, the combination may be administered in two or more administrations.

In certain embodiments, an antibody or fragment thereof disclosed herein is combined with one or more additional therapeutic agents in a unitary dosage form for simultaneous administration to a patient, for example as a solid dosage form for oral administration.

In certain embodiments, an antibody or fragment thereof disclosed herein is administered with one or more additional therapeutic agents. Co-administration of an antibody or fragment thereof disclosed herein with one or more additional therapeutic agents generally refers to simultaneous or sequential administration of an antibody or fragment thereof disclosed herein and one or more additional therapeutic agents, such that therapeutically effective amounts of the antibody or fragment thereof disclosed herein and one or more additional therapeutic agents are both present in the body of the patient.

Co-administration includes administration of unit dosages of the antibodies or fragments thereof disclosed herein before or after administration of unit dosages of one or more additional therapeutic agents, for example, administration of the antibody or fragment thereof disclosed herein within seconds, minutes, or hours of the administration of one or more additional therapeutic agents. For example, in some embodiments, a unit dose of an antibody or fragment thereof disclosed herein is administered first, followed within seconds or minutes by administration of a unit dose of one or more additional therapeutic agents. Alternatively, in other embodiments, a unit dose of one or more additional therapeutic agents is administered first, followed by administration of a unit dose of an antibody or fragment thereof disclosed herein within seconds or minutes. In some embodiments, a unit dose of an antibody or fragment thereof disclosed herein is administered first, followed, after a period of hours (e.g., 1-12 hours), by administration of a unit dose of one or more additional therapeutic agents. In other embodiments, a unit dose of one or more additional therapeutic agents is administered first, followed, after a period of hours (e.g., 1-12 hours), by administration of a unit dose of an antibody or fragment thereof disclosed herein.

The combined administration may be co-administration, using separate pharmaceutical compositions or a single pharmaceutical composition, or consecutive administration in either order, wherein there is optionally a time period while both (or all) therapeutic agents simultaneously exert their biological activities. Such combined therapy may result in a synergistic therapeutic effect. In certain embodiments, it is desirable to combine administration of an antibody of the invention with another antibody or antigen-binding fragment thereof directed against another antigen associated with the infectious agent.

Aside from administration of the antibody or antigen-binding fragment thereof protein to the subject, the invention also provides methods of providing the antibody by gene therapy. Such administration of nucleic acid encoding the antibody is encompassed by the expression "administering an effective amount of an antibody or antigen-binding fragment thereof." See, for example, PCT Patent Application Publication WO96/07321 concerning the use of gene therapy to generate intracellular antibodies. In particular embodiments, the nucleic acid comprises one or more polynucleotides encoding the antibody or antigen-binding fragment thereof. In certain embodiments, the polynucleotide encodes an scFv. In particular embodiments, the polynucleotide comprises DNA, cDNA or RNA. In certain embodiments, the polynucleotide is present in a vector, e.g., a viral vector

EXAMPLES

The application may be better understood by reference to the following non-limiting examples, which are provided as exemplary embodiments of the application. The following examples are presented in order to more fully illustrate embodiments of the invention and should in no way be construed, however, as limiting the broad scope of the application. While certain embodiments of the present application have been shown and described herein, it will be obvious that such embodiments are provided by way of example only. Numerous variations, changes, and substitutions will now occur to those skilled in the art without departing from the invention. For example, some assays may be conducted at different conditions and may generally produce results within a range of the reported values. It should be understood that various alternatives to the embodiments described herein may be employed in practicing the methods described.

Example 1: Methods of Synthesizing Antibodies

For all antibodies described herein, the coding sequence of the variable region of the variable heavy chain (VH) and variable light chain (VL), including the respective signal peptide and Kozak sequence, was codon-optimized for *Homo sapiens* expression and de novo synthesized by GENEART™. The signal peptide of a mouse heavy chain (mewsrvfifl lsvtagvhsq vqlqqsgael vrpgtsvkvs ckasgyaftn yliewvkqrp gqglewigvi npgsggtnyn ekfkgkatlt adkssstaym qlssltseds avyfcarsyy gydwfaywgq gtivtvsa (SEQ ID NO: 61); GenBank Accession no. AF045502.1) and that of a mouse light chain (MRCLAEFLGLLVLWIPGAIGDIVMTQAAPSVPVTPGESVSISCRSSTSLLHSSGKHRLYW FLQRPGQSPQLLIYYMSNLASGVPDRFSGSGSGTDFTLRISRVEAEDFGVYYCMQSLEYP (SEQ ID NO: 62); GenBank Accession no. ADK97503.1) were used as the respective signal peptides for heavy chain (HC) and light chain (LC), respectively. The DNA fragments encoding VH and VL were cloned into a mammalian expression vector, pcDNA3.1, with its respective constant region by a ligation-independent cloning method Infusion (INFUSION® cloning).

For transient expression of the antibodies in 293 cell line-derived EXPI293F™ cells, the manufacturer's protocol was followed. In brief, $2.5 \times 10^9$ cells in 1 liter of Expi293 medium were transfected with 0.6 milligram of the light chain and 0.4 milligram of the heavy chain plasmid using 2.7 ml of Expifectamine transfection reagent. The culture was incubated at 37° C. with 8% $CO_2$ in a humidified incubator for 5-6 days post-transfection. The cell-free supernatant was harvested for purification when the viability reached approximately 60%.

Purification of the expressed IgGs was performed by Protein A affinity followed by dialysis. PreSanitized GE mabselect protein A (SURE®) resin was equilibrated in PBS pH7.4, and the volume of resin used was consistent with 20 mg/ml capacity expected expression. The 0.2 um filtered harvest conditioned media was passed through the resin at 0.7×Col vol/min. When the load was complete, a wash step of 10×col vol PBS pH7.4 was performed. This was followed by a pH3.6 elution step that was then immediately neutralized to pH5.5. This pool was dialyzed into either PBS pH 7.4 or 20 mM Sodium Acetate, 9% Sucrose and 0.02% Tween 20 pH5.5 and 0.2 um filtered and stored at 4° C.

Other similar methods could also be used to generate the antibodies described herein, including those described in PCT Application Publication No. WO2012/030904.

Example 2: In Vitro Characterization of Neutralizing Anti-HIV-1 Antibodies

Antibodies were characterized using a variety of assays to determine their melting temperature, resistance to aggregation during low pH hold procedures, target binding and HIV neutralization activity and breadth, their direct binding to FcRn and FcgRs, effector cell activation and killing activity, and potential for immunogenicity.

Melting Temperature

The thermal stability of PGT-121 LO6 and antibodies of the present invention was determined using either Differential Scanning Fluorimetry (DSF) or Differential Scanning Calorimetry (DSC) (Niesen F H et al. 2007, Nature Protocol 2:2212-2221, Garber E and Demarest S J. 2007. Biochem and Biophys Res Commun 355: 751-757). In both assays, changes in the Fab domain unfolding transition were monitored to determine the effects of various point mutations introduced into PGT121 WT.

Figure 3:
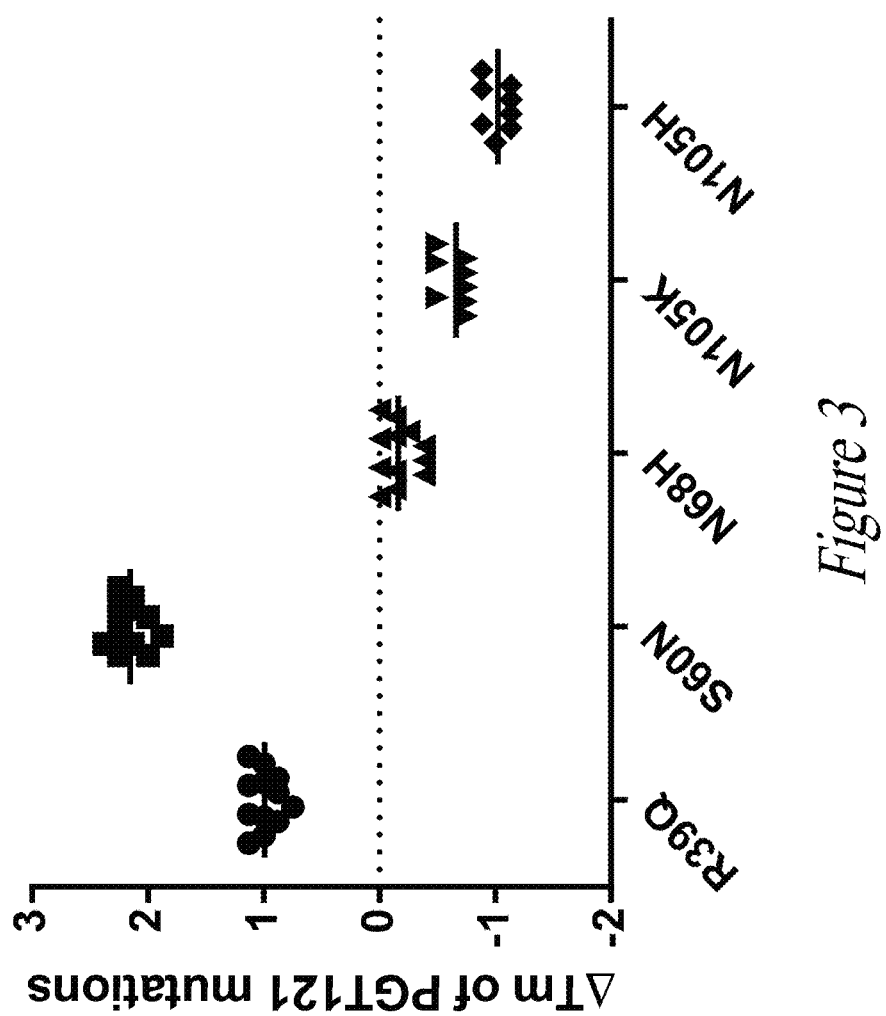
FIG. 3 is a graph showing paired analysis of unique variants differing only at the amino acid indicated, revealing mutations that both stabilize or destabilize the Fab domain. The change in Tm of the various PGT121 mutants as compared to the Tm of PGT121 WT is shown.

DSF measures the temperature of thermal unfolding transition of a protein (Tm) based on the change in fluorescence intensity of the environmentally sensitive dye SYPRO Orange. DSF was carried in 96-wells MicroAmp Fast reaction plate using ViiA7 Real-Time PCR machine (Life Technologies, Grand Island, N.Y.) in formulation buffer containing PBS, pH 7.4 or 20 sodium acetate, 9% sucrose, pH 5.5. Antibody at 1 mg/mL concentration was combined with 1:1000 diluted Sypro Orange fluorescent probe (all concentration are final after mixing) in 25 µL volume per well. Thermal denaturation was carried out within 5-10 min of dye addition by increasing the temperature from 20° C. to 95° C. with rate of 1° C./minute. Fluorescence intensity data were collected at 0.07° C. interval (excitation at 490 nm and emission with the use of a ROX filter at 600 to 630 nm) and were analyzed with Protein Thermal Shift Software (Invitrogen) using first derivative approach to calculate the Tm. In this method, Tm is a temperature corresponding to the maximum value of the first derivative of the DSF melting curve. For antibodies with multiple melting transitions, Tm1 and Tm2 referred to the melting temperature for the first and the second discrete melting transition, respectively. The results of DSF analysis are shown in FIGS. 2 and 3.

Figure 4:
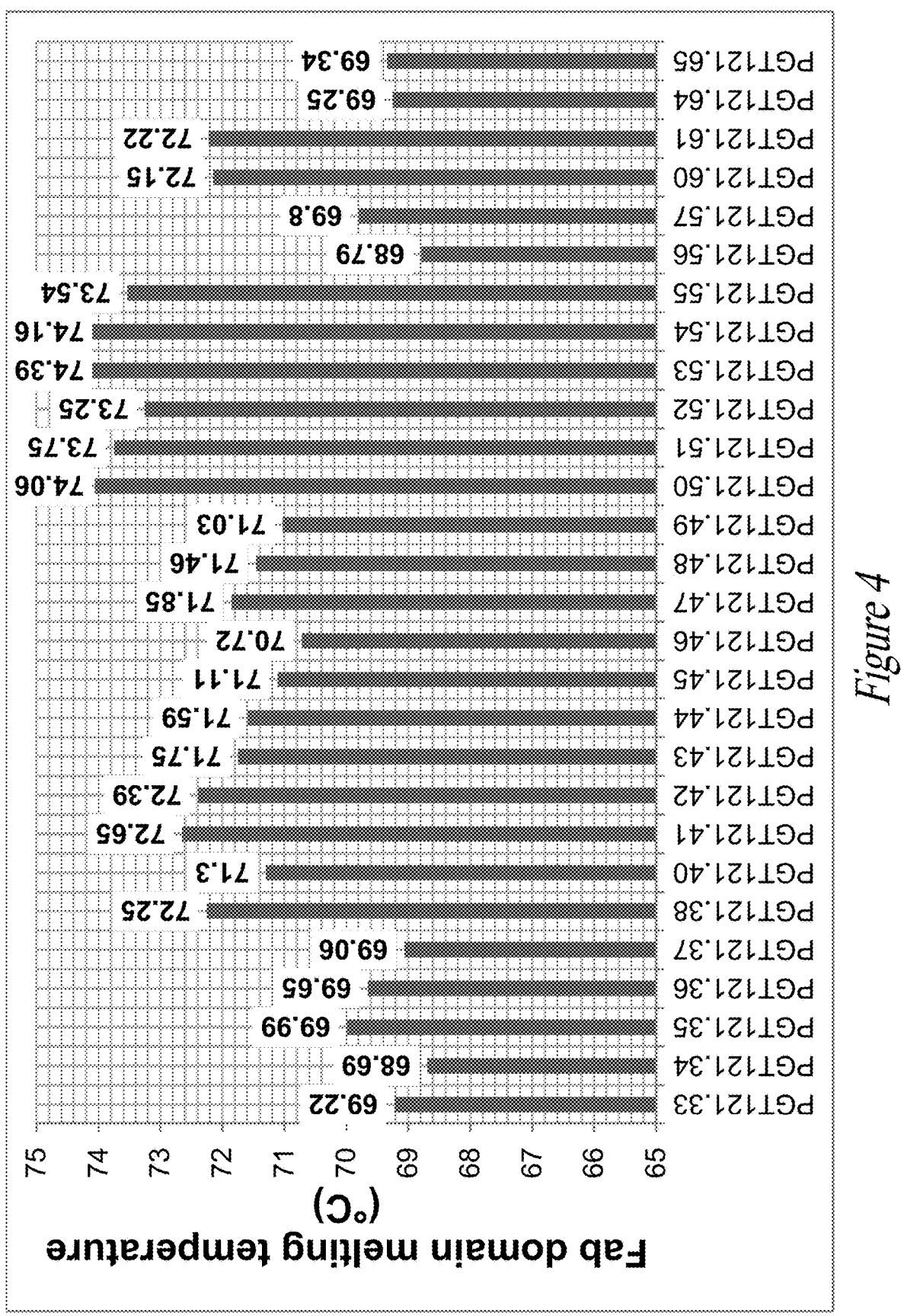
FIG. 4 is a graph showing the Fab melting temperature of the Fab domains of selected PGT121 variants as determined by DSC.

DSC experiments were performed using a MicroCal VP-Capillary DSC (GE Healthcare, Piscataway, N.J.). The samples were buffer exchanged into a 20 mM sodium acetate, 9% sucrose pH 5.5 formulation buffer and diluted to the final concentration of 1 mg/mL. The formulation buffer was used as the reference solution for each measurement. Thermal denaturation of samples was achieved by increasing the temperature of protein solution from 25° C. to 95° C. at the scan rate of 1° C. per minute. Data was analyzed after subtraction of reference buffer and linear baseline subtraction. The three transition melting temperatures for each sample were obtained after fitting each the thermogram to a Non-2 state model with three transitions using Origin 7 software (OriginLab v7.0552). FIG. 4 shows the Tm of the Fab domains as determined by DSC for selected PGT121 variants.

Table 4 summarizes illustrative mutations that increase the thermal stability of PGT121 antibodies of the present invention.

TABLE 4

| Mutations that increase the thermal stability of PGT121 | |
| --- | --- |
| Mutation (Kabat Numbering) | Mean increase in Tm (° C.) |
| V82aS, A82bS, A82cV | 1.1 |
| R39Q | 1.0 |
| S60N | 2.2 |

Post-Translational Modifications of PGT121 and Variants

PGT121 LO6 has three consensus glycosylation sites in the heavy chain variable region. While the presence of glycosylation at the third site (N105 linked, Kabat numbering) has been previously confirmed (Mouquet et al. 2012. PNAS 109: E3268-E3277), the glycosylation status of the other sites was unknown. Glycosylation, including that on the Fc or Fab domains can be heterogeneous and have impacts on PK, drug safety and immunogenicity (Jones et al. 2007. Glycobiology 17: 529-540, Alessandri et al. 2012. mAbs 4: 509-520, Goetze et al. 2011. Glycobiology 21: 949-959, Chung et al. 2008. NEJM 358:1109-1117). The Fab glycan content in PGT121 and selected variants was analyzed in a mass spectrometry peptide mapping assay similar to those described (Zhang Z. 2009. Anal. Chem. 81: 8354-8364, Shah et al. 2014. J. Am. Soc. Mass Spectrom. 25:999-1011). The results of this assay revealed detectable and heterogeneous glycosylation at both N68 (5.5% glycosylated) and N105 (92.4% glycosylated), as indicated in Tables 5 and 6. Peptide mapping analysis of N68 glycosylation for PGT121 WT showed that N68 was approximately 3.7% glycosylated, with multiple glyco-forms present as shown (naming consistent with IMGT conventions, -N=loss of GlcNAc; bN=bisecting GlcNAc), as shown in Table 6. Peptide mapping analysis of N105 glycosylation for PGT121 WT showed that N105 was 100% glycosylated, with multiple glyco-forms present as shown (naming consistent with IMGT conventions, -N=loss of GlcNAc; bN=bisecting GlcNAc). Man5 containing glycans that have been implicated in poor pharmacokinetic properties are shaded (Goetze et al. 2011. Glycobiology 21: 949-959).

TABLE 5

Glycosylation of N68 of PGT121 LO6

| Molecule | PGT121 WT |
|---|---|
| G1F bN | 0.30% |
| G1F + NANA | 0.40% |
| G1F bN + NANA | 1.00% |
| G2F2 + NANA | 0.60% |
| G2F + NANA | 0.80% |
| G1F2 + NANA | 0.30% |
| G2F + 2 NANA | 0.40% |
| Total Glycosylation | 3.70% |

TABLE 6

Glycosylation of N105 of PGT121 LO6

| Molecule | PGT121 WT |
|---|---|
| Man5 | 25.80% |
| G1F − N | 2.10% |
| G0F | 3.90% |
| G1F | 15.40% |
| G0F bN | 12.40% |
| G2F | 9.10% |
| G1F bN | 3.40% |
| G1F + NANA | 27.90% |
| Total Glycosylated | 100.00% |

Binding to Gp120 Antigen and Fc Receptors

The in vitro binding characteristics of antibodies for both the antigen (HIV gp120) and Fc binding receptors (FcγRs, FcRn) were determined using an Enzyme-Linked Immunosorbant Assay (ELISA). For the gp120/gp140 ELISA assay, 25 μL of recombinant gp120 protein was coated on 384 well NUNC Maxisorp plates at 1 μg/mL in PBS pH 7.4 overnight at 4° C. with gentle rocking, the plate was blocked with 5% BSA in PBS pH 7.4 for 1 hour, the plate was washed 4 times with PBS pH 7.4+0.05% Tween 20 (PBST), 25 μL of a three-fold dilution series of antibody in PBS pH 7.4+1% BSA with a maximum antibody concentration of 300 nM was incubated in the wells for 1 hour with shaking at 600 RPM at room temperature, the plate was washed 4 times with PBST, 25 μL of HRP conjugated Thermo goat-anti-human IgG (H+L) polyclonal diluted 1:10,000 in PBS was incubated with the wells for 1 hour with shaking at 600 RPM at room temperature, the plate was washed 4 times with PBST, 25 μL of TMB substrate was added to the wells, the plate was incubated at room temperature for 120 seconds, 25 μL of 1M HCl as added to the wells, absorbance at 450 nM was read on a Spectramax plate reader, and the resulting points were fit using non-linear regression to determine an ELISA EC50 value.

Figure 5:
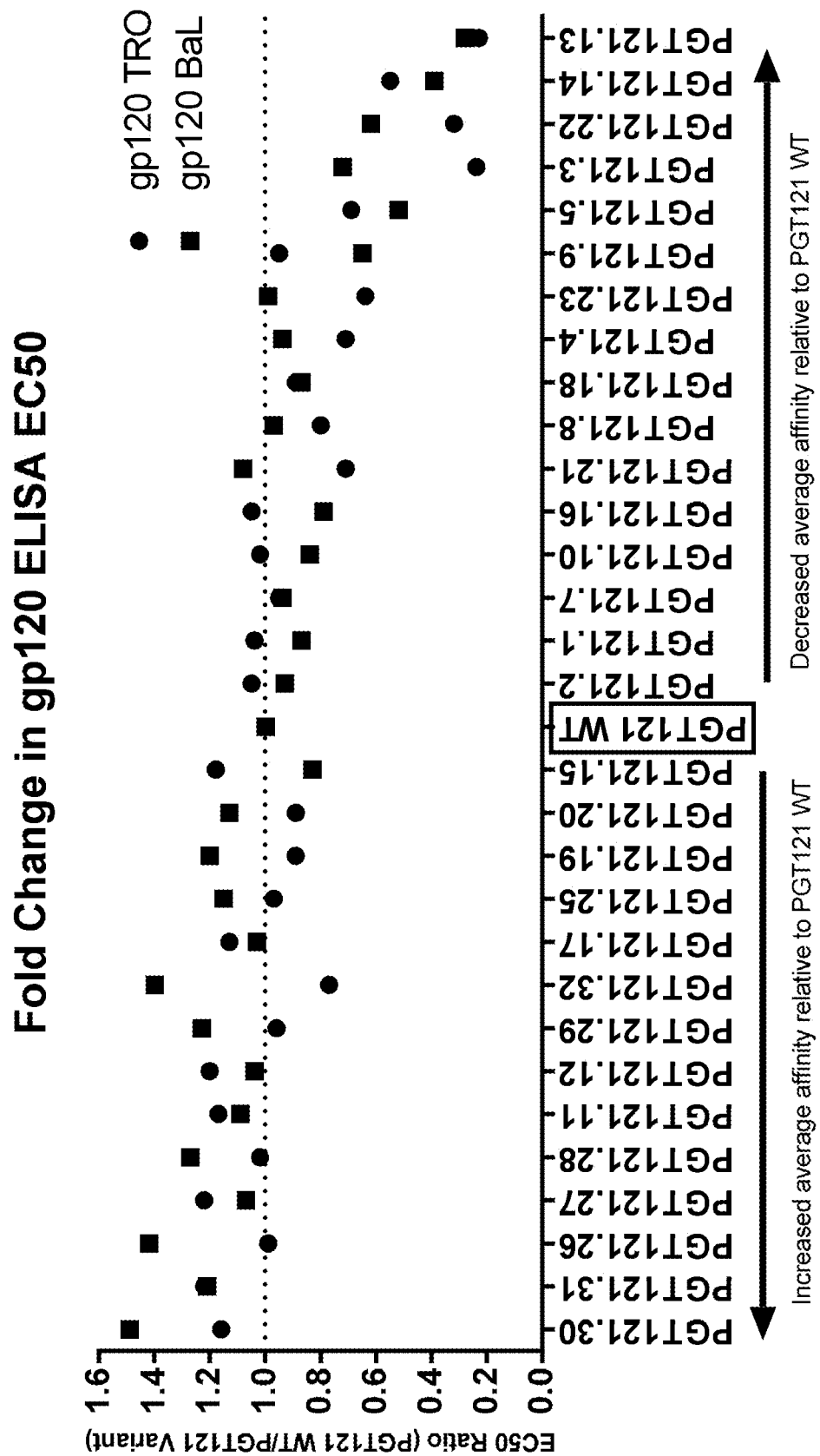
FIG. 5 is a graph showing the fold change in gp120 ELISA EC50 for selected PGT121 variants as compared to PGT121 LO6 WT. Dotted line at an EC50 ratio of 1 indicates no change in affinity. PGT121 LO6 WT is boxed. Variants with EC50 ratios>1 for a given gp120 strain (gp120BaL or gp120TRO as shown) have improved antigen binding affinity compared to PGT121 WT, while variants with EC50 Ratios<1 for a given gp120 strain have decreased antigen binding affinity compared to PGT121 WT.
Figure 6:
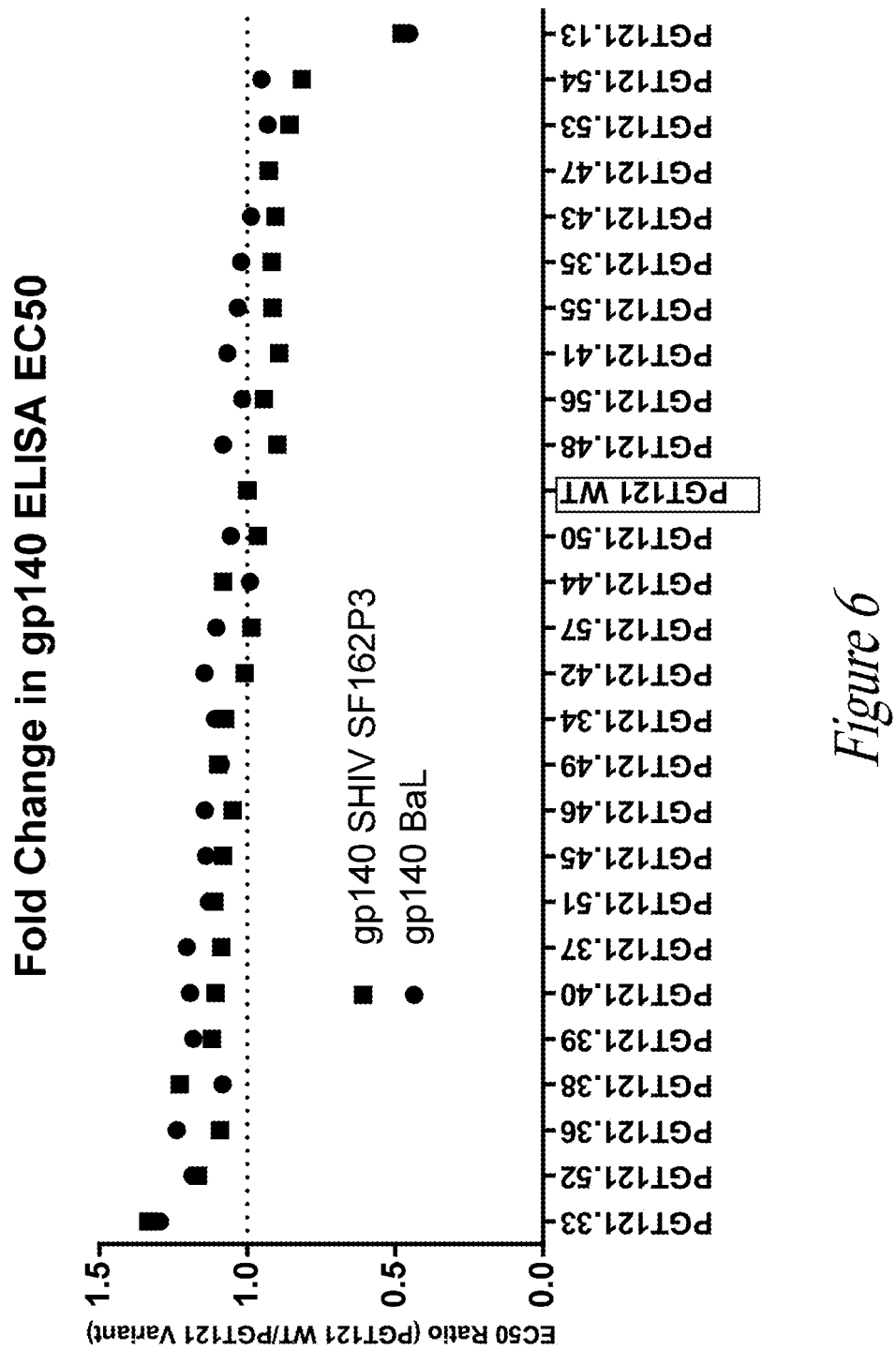
FIG. 6 is a graph showing fold change in gp140 ELISA EC50 for PGT121 variants Compared to PGT121 LO6 WT. The dotted line at an EC50 ratio of 1 indicates no change in affinity. PGT121 LO6 WT is boxed. Variants with EC50 ratios>1 for a given gp140 strain (gp140 BaL and gp140 SHIV SF162P3 are shown) have improved antigen binding affinity compared to PGT121 LO6 WT, while variants with EC50 Ratios<1 for a given gp120 strain have decreased antigen binding affinity compared to PGT121 LO6 WT.
Figure 7:
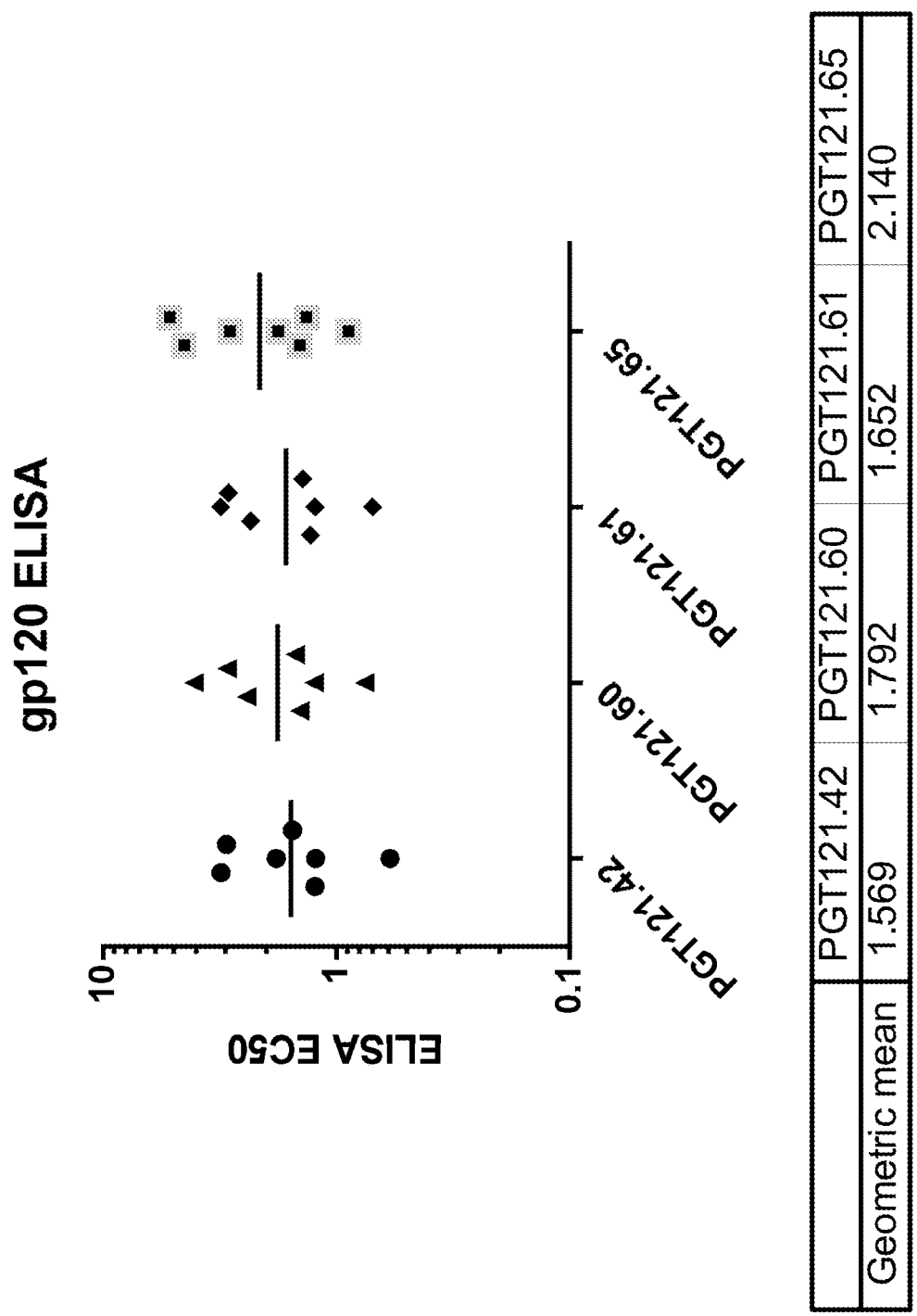
FIG. 7 is a graph showing EC50 (nM) values for PGT121 variants determined against recombinant gp120 from 7 unique HIV strains (BaL, pRHPA4259, qh0692, 6535, pCAAN5342, pWITO4160, and AC10.0). In contrast to PGT121 WT, there is no statistically significant difference in gp120 binding between the specific variants PGT121.42, PGT121.60, PGT121.61, and PGT121.65.

Multiple Env sequences were used to assess binding in either gp120 and/or gp140 formats, including BaL, TRO, SHIV, SF162 P3, pRHPA4259, qh0692, 6535, pCAAN5342, pWITO4160, and AC10.0. The apparent EC50 values from these assays are shown below for PGT121 LO6 WT, as well as selected PGT121 variants described herein, and indicate their relative binding affinities (see Tables 7 and 8). FIGS. 5 and 6 demonstrate that some of the single site PGT121 variants made for other reasons, e.g., to improve low pH stability, improve immunogenicity, remove glycosylation sites, etc.) resulted in reduced target binding affinity, while others improved it. FIG. 7 shows the gp120 of selected PGT121 variants. These results demonstrate that only certain mutations do not negatively impact gp120 binding affinity.

TABLE 7

ELISA EC50 values for PGT121 WT and selected variants against gp120 BaL and gp120 TRO

| Variant Name | EC50 TRO (nM) | EC50 BaL (nM) |
|---|---|---|
| PGT121.30 | 1.142 | 5.694 |
| PGT121.26 | 1.342 | 5.981 |
| PGT121.32 | 1.713 | 6.066 |
| PGT121.28 | 1.306 | 6.706 |
| PGT121.31 | 1.090 | 7.057 |
| PGT121.29 | 1.388 | 6.914 |
| PGT121.19 | 1.497 | 7.111 |
| PGT121.25 | 1.366 | 7.434 |
| PGT121.11 | 1.137 | 7.805 |
| PGT121.20 | 1.498 | 7.560 |
| PGT121.27 | 1.090 | 7.970 |
| PGT121.12 | 1.106 | 8.221 |
| PGT121.17 | 1.178 | 8.243 |
| PGT121.21 | 1.877 | 7.881 |
| PGT121 WT | 1.327 | 8.512 |
| PGT121.2 | 1.260 | 9.143 |
| PGT121.8 | 1.654 | 8.780 |
| PGT121.7 | 1.396 | 9.093 |
| PGT121.23 | 2.089 | 8.583 |
| PGT121.4 | 1.859 | 9.090 |
| PGT121.1 | 1.282 | 9.799 |
| PGT121.18 | 1.489 | 9.832 |
| PGT121.15 | 1.127 | 10.240 |
| PGT121.10 | 1.297 | 10.150 |
| PGT121.16 | 1.263 | 10.780 |
| PGT121.9 | 1.399 | 13.080 |
| PGT121.3 | 5.582 | 11.860 |
| PGT121.22 | 4.120 | 13.700 |
| PGT121.5 | 1.927 | 16.370 |
| PGT121.14 | 2.429 | 21.710 |
| PGT121.13 | 5.802 | 30.660 |

TABLE 8

ELISA EC50 values for PGT121 WT and selected variants against gp140 BaL and gp140 SHIV SF162P3

| Variant Name | EC50 (nM) gp140 BaL | EC50 (nM) gp140 SHIV SF162P3 |
|---|---|---|
| PGT121.46 | 0.52 | 0.43 |
| PGT121.39 | 0.50 | 0.40 |
| PGT121.52 | 0.50 | 0.39 |
| PGT121.36 | 0.48 | 0.41 |
| PGT121.48 | 0.55 | 0.50 |
| PGT121.44 | 0.60 | 0.42 |
| PGT121.33 | 0.46 | 0.34 |
| PGT121.45 | 0.52 | 0.42 |
| PGT121.57 | 0.54 | 0.46 |
| PGT121.40 | 0.50 | 0.41 |
| PGT121.35 | 0.58 | 0.49 |
| PGT121.49 | 0.55 | 0.41 |
| PGT121 WT | 0.60 | 0.45 |
| PGT121.51 | 0.53 | 0.41 |
| PGT121.56 | 0.59 | 0.48 |
| PGT121.37 | 0.50 | 0.42 |
| PGT121.38 | 0.55 | 0.37 |
| PGT121.50 | 0.57 | 0.47 |
| PGT121.42 | 0.52 | 0.45 |
| PGT121.47 | 0.64 | 0.49 |

TABLE 8-continued

ELISA EC50 values for PGT121 WT and selected variants against gp140 BaL and gp140 SHIV SF162P3

| Variant Name | EC50 (nM) gp140 BaL | EC50 (nM) gp140 SHIV SF162P3 |
|---|---|---|
| PGT121.54 | 0.63 | 0.55 |
| PGT121.43 | 0.60 | 0.50 |
| PGT121.34 | 0.54 | 0.42 |
| PGT121.41 | 0.56 | 0.51 |
| PGT121.55 | 0.58 | 0.49 |
| PGT121.53 | 0.64 | 0.53 |
| PGT121.13 | 1.32 | 0.94 |

Figure 8A:
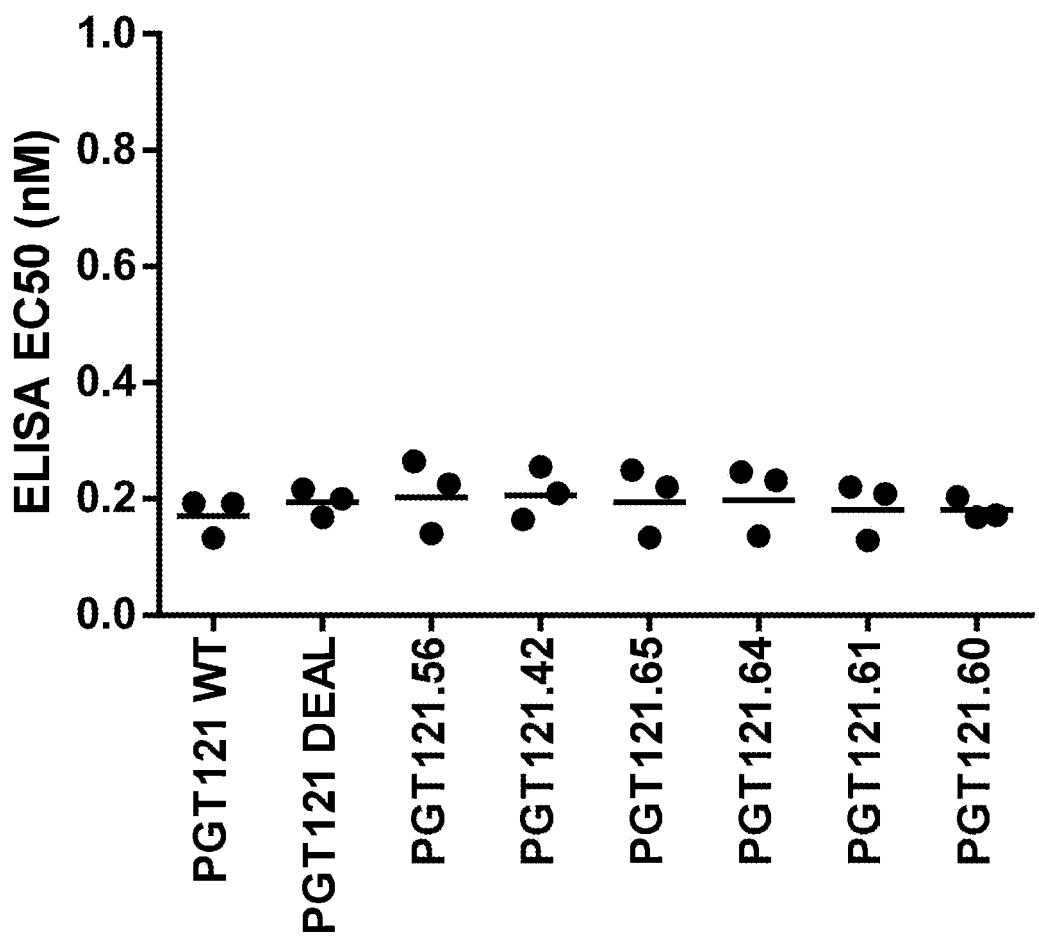
FIGS. 8A-8H provides graphs showing the results of ELISA using various recombinant human FcγR extracellular domains and PGT121 WT and Fc and Fab variants (8A, FcγRI; 8B, FcγRIII-176F; 8C, FcγRIII-176V; 8D, FcγRII-167H; 8E, FcγRIIA-167R; 8F, FcγRIIB; 8G, FcγRIIIB-NA1; 8H, FcγRIIIB-NA2). Biotinylated human FcγR extracellular domains were captured on neutravidin coated 384 well plates at 0.5 ug/mL. 12 point ELISA titrations were conducting with the indicated antibodies, data fit with a 4-parameter dose-response curve and EC50 values calculated. Grey line is at the geometric mean of EC50 values determined in multiple unique experiments (each data point represents a unique experiment conducted in duplicate).
Figure 8B:
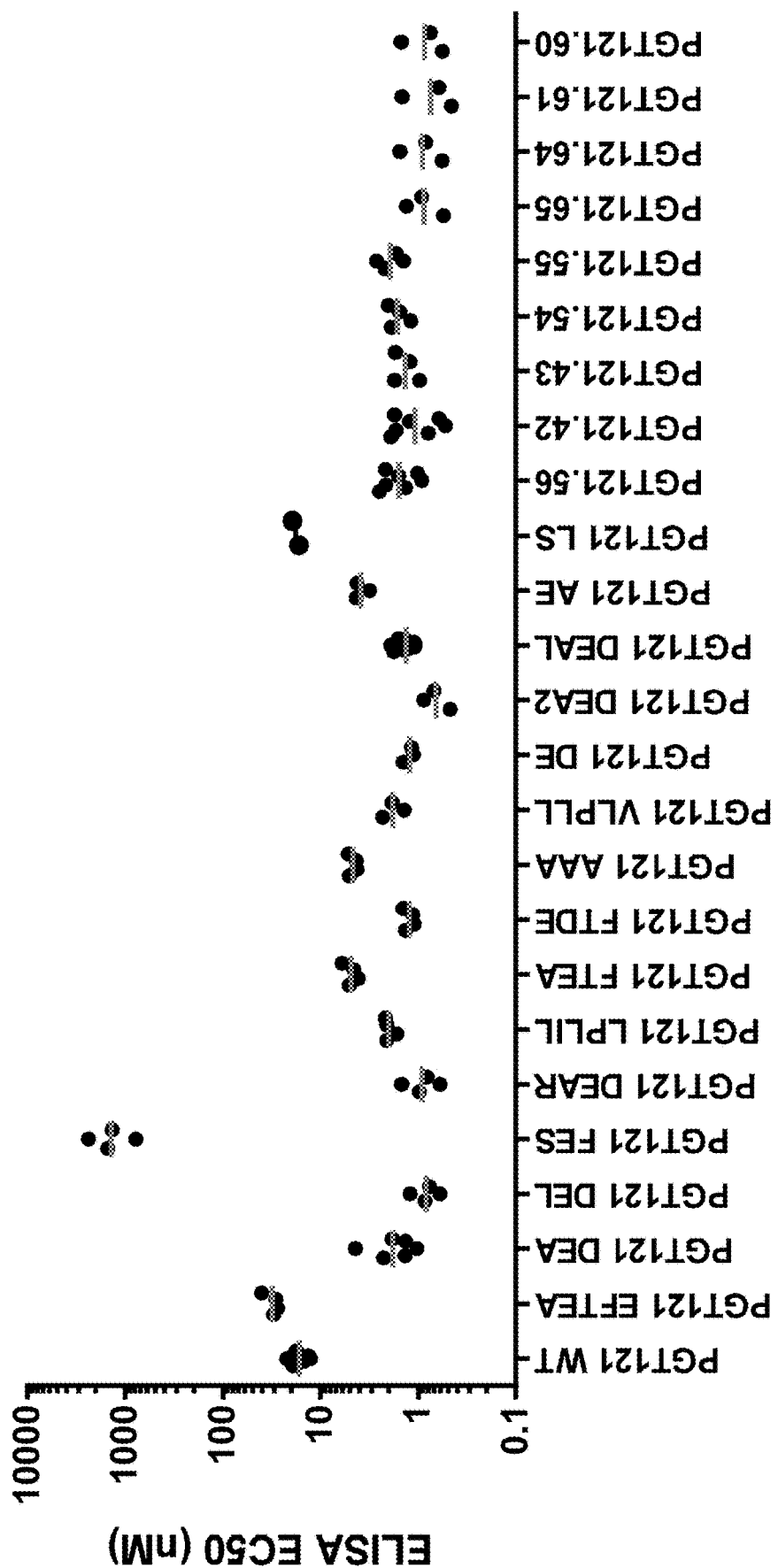
Figure 8C:
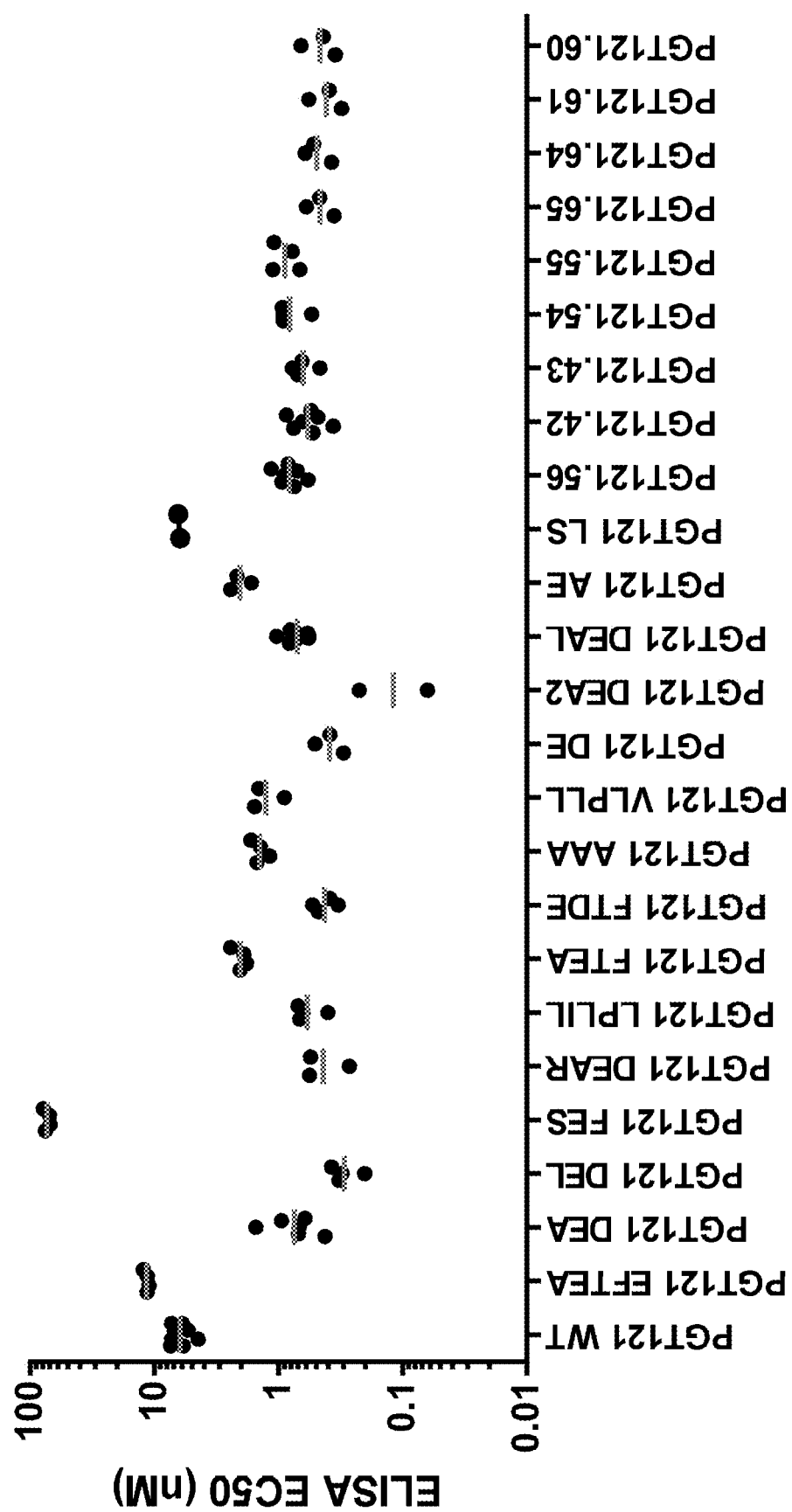
Figure 8D:
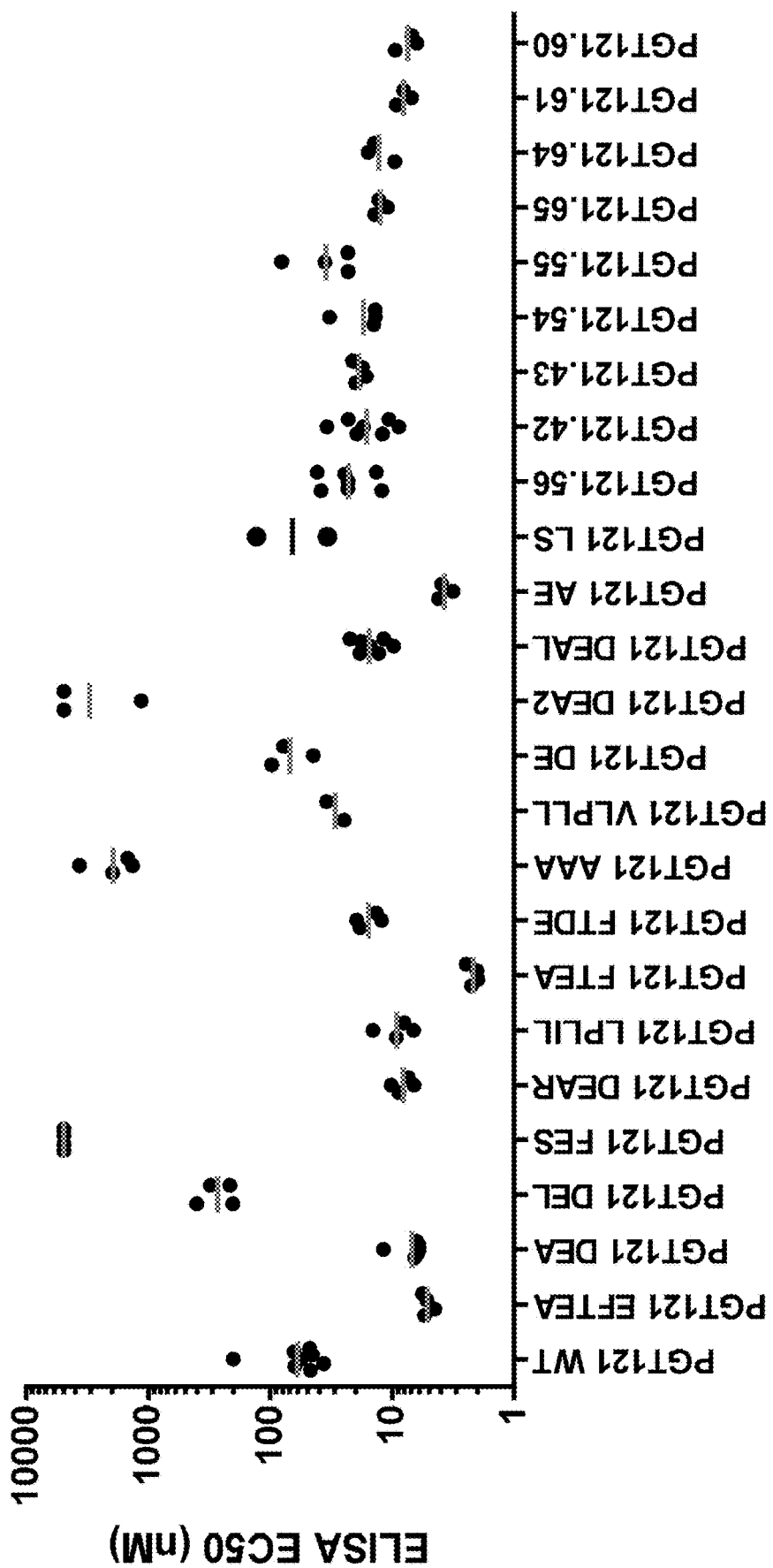
Figure 8E:
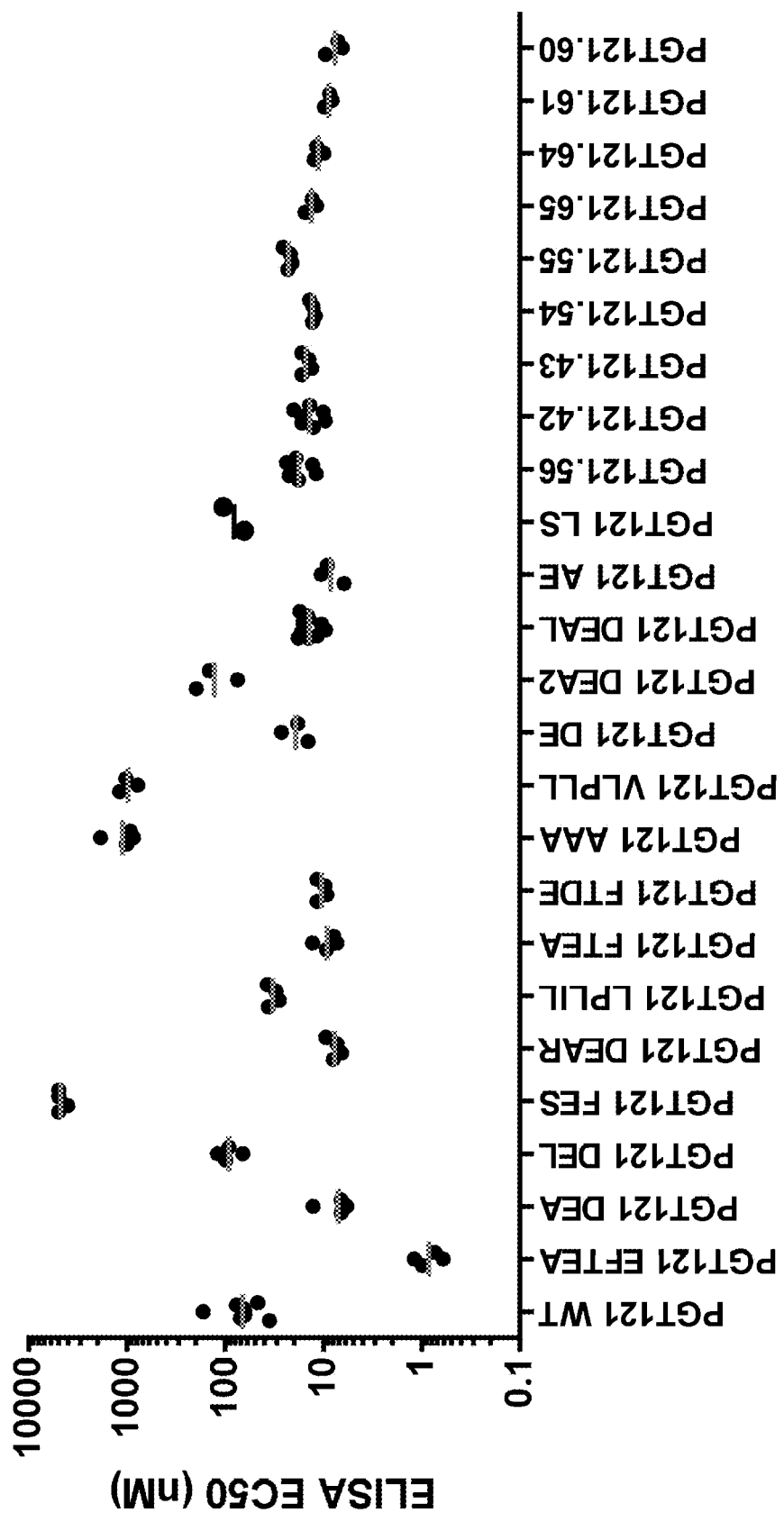
Figure 8F:
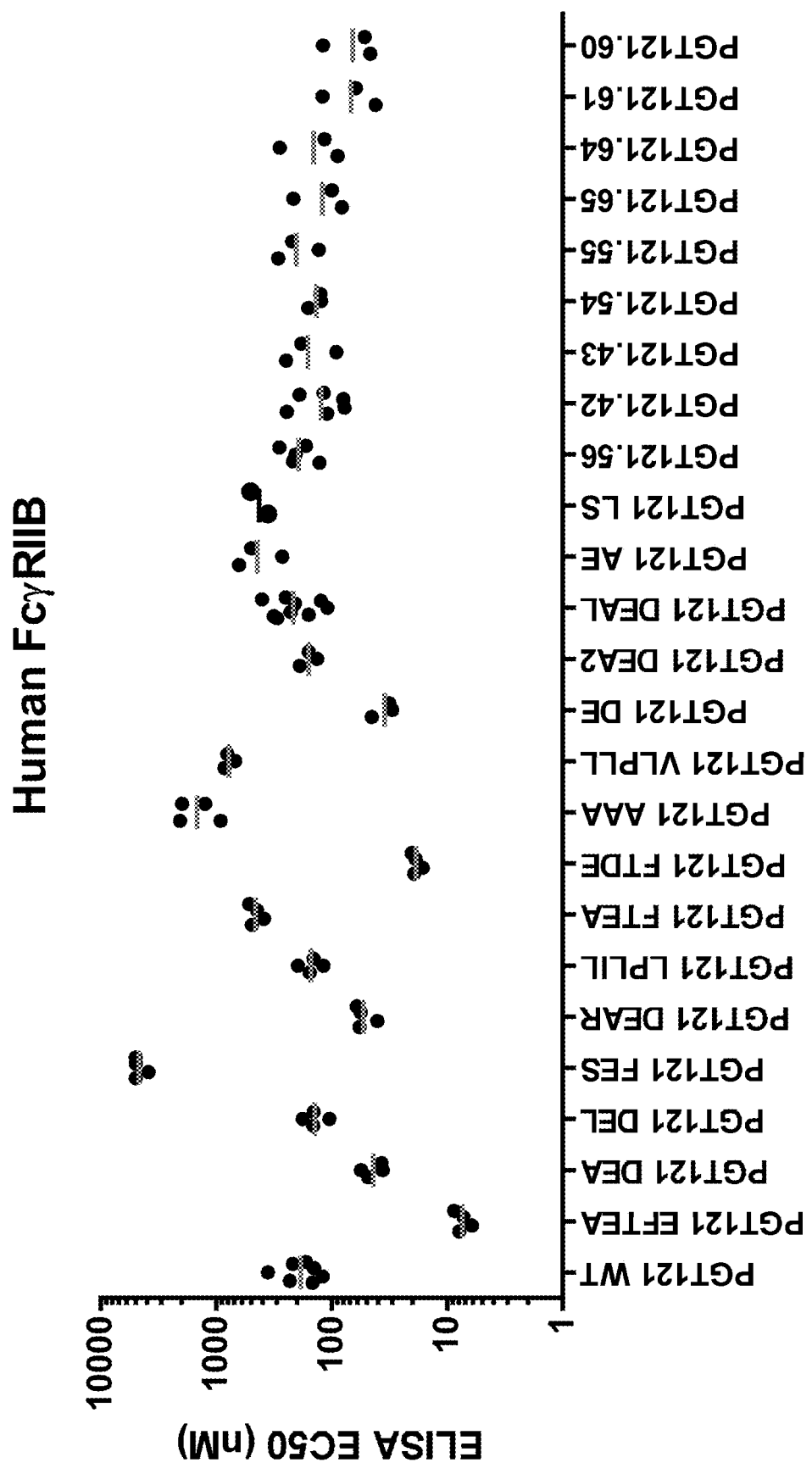
Figure 8G:
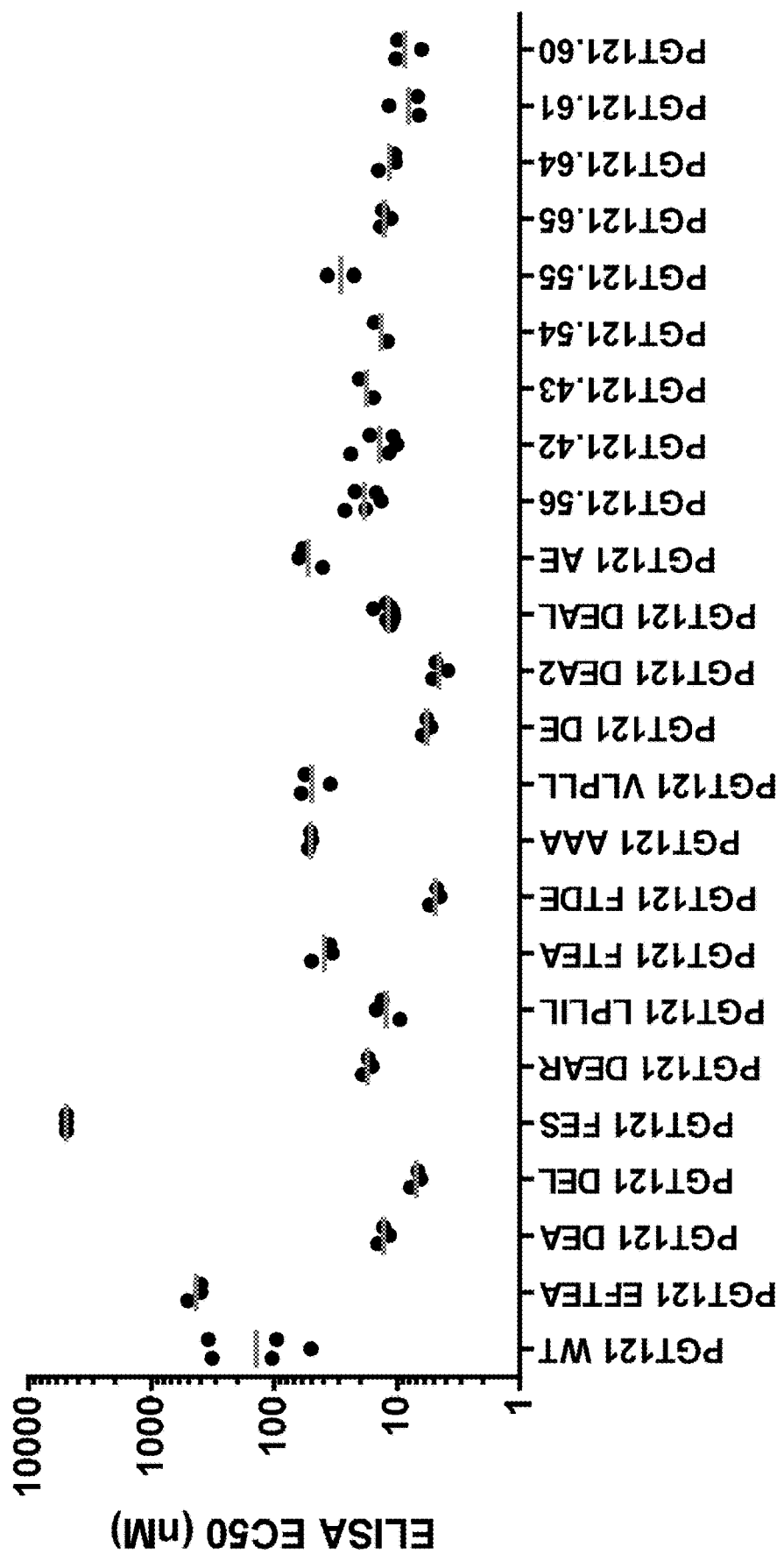
Figure 8H:
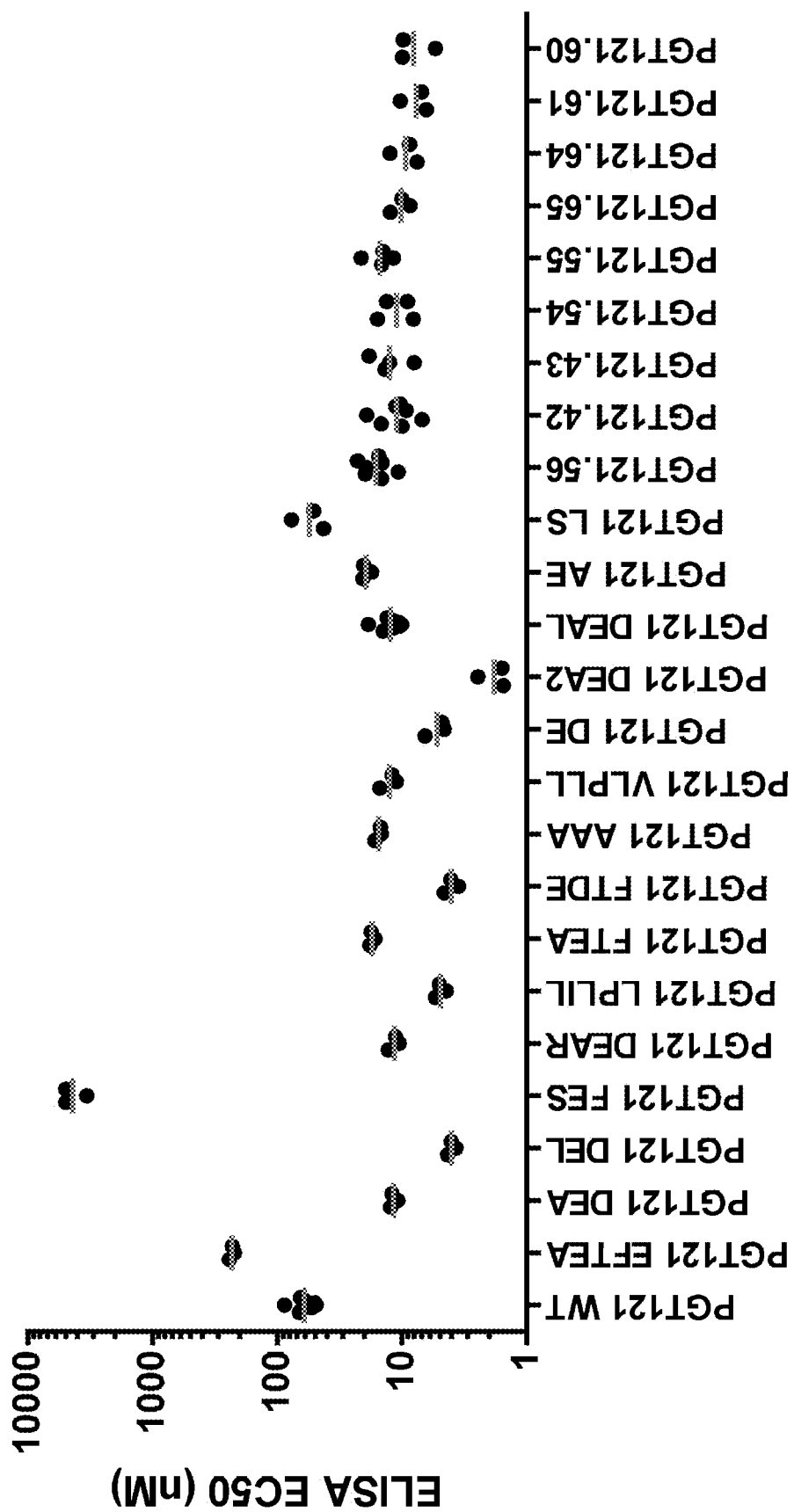

For the FcγR ELISA assay, the antigen used was the extracellular domain of a human FcγR containing a C-terminal peptide tag (AVITAG™), with a single biotin conjugated by the bacterial BirA protein. To conduct the assay, 25 µL of 0.5 µg/mL FcγR diluted in PBS pH 7.4+1% bovine serum albumin (BSA) was incubated the wells of a 384 well deglycosylated avidin (NEUTRAVIDIN™) coated ELISA plate (PIERCE™) for 1 hour at room temperature with shaking at 600 RPM, the plate was washed 5 times with PBST, 25 µL of a 3.5-fold dilution series of antibody in PBS pH 7.4+1% BSA with a maximum antibody concentration of 5000 nM as incubated in the wells for 1 hour with shaking at 600 RPM at room temperature, the plate was washed 5 times with PBS pH 7.4+0.05% Tween 20 (PBST), 25 µL of horseradish peroxidase (HRP) conjugated goat F(ab')2 anti-human F(ab')2 polyclonal (Jackson ImmunoResearch) diluted 1:5,000 in PBS pH 7.4+1% BSA was incubated with the wells for 30 minutes with shaking at 600 RPM at room temperature, the plates was washed 5 times with PBST, 25 µL of TMB substrate was added to the wells, the plate was incubated at room temperature for 120 seconds, 25 µL of 1M HCl was added to the wells, absorbance at 450 nM was read on a Spectramax plate reader, and the resulting points were fit using non-linear regression to determine an ELISA EC50 value using methods known in the art. The EC50 values as determined in these assays for PGT121 WT and variants are shown in FIG. 8A. Similar experiments were performed to determine the EC50 of PGT121 WT and variants comprising various point mutations using other recombinant human FcγRs, and the results are shown in FIG. 8B-8H.

Binding to Recombinant HIV Env in Transfected Human Cell Lines

Figure 9:
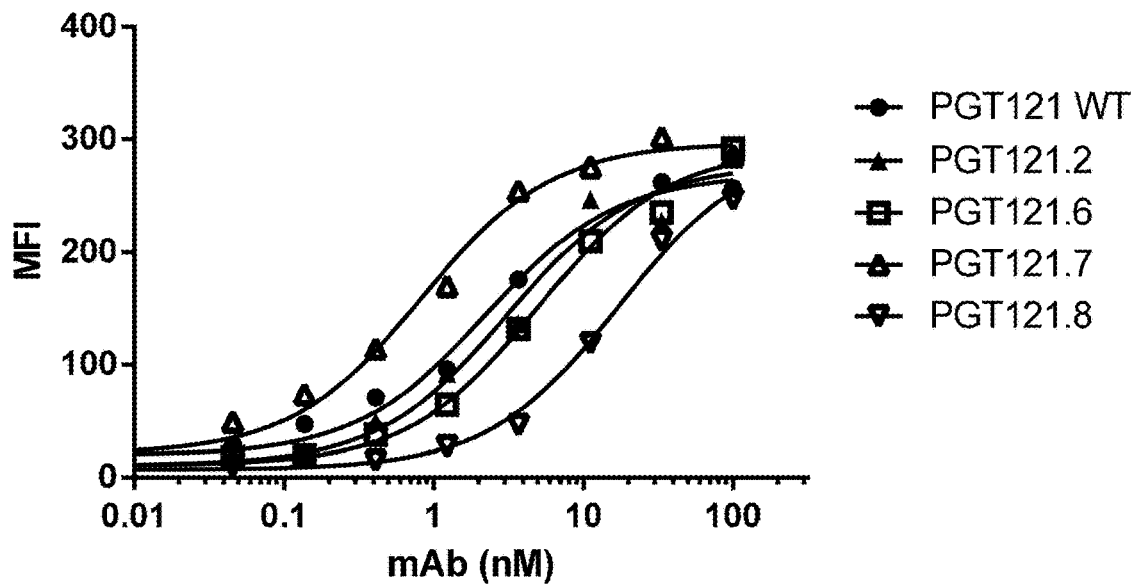
FIG. 9 shows that PGT121 WT and Fab variants bind to recombinant HIV Env in transfected human cells. Recombinant HIV Env BaL was transfected in HEK293T cells. The transfected cells were incubated with the indicated antibodies at different concentrations. After flow cytometry, collected MFIs were fitted to non-linear regression dose-response curve.
Figure 10:
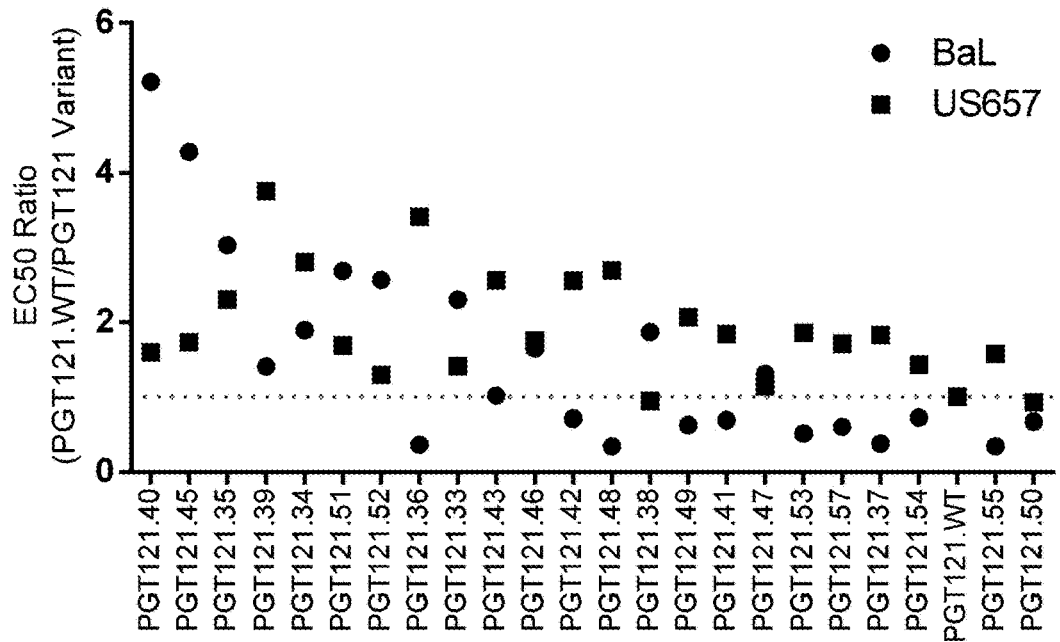
FIG. 10 shows the fold change in recombinant HIV Env binding EC50 for PGT121 variants compared to PGT121 WT. Dotted line at an EC50 ratio of 1 indicates no change in affinity. Variants with EC50 ratios>1 for a given recombinant HW Env strain (BaL or US657 as shown) have improved antigen binding affinity compared to PGT121 WT, while variants with EC50 ratios<1

The binding of the antibodies to recombinant HIV Env expressed on the surface of transfected HEK293 cell lines was assessed using flow cytometry. Three Env sequences were employed for the binding studies including BaL, US92HT593 and U92US657. For the binding assay, the recombinant HIV Env constructs were transfected in HEK293T cells. The cells were harvested 48 hours post transfection and incubated with the antibodies in a serial dilution at 4 degree for 1 hour. The cells were then washed and incubated with a secondary goat anti-human IgG Alexa488 conjugated antibody. The binding was then detected and quantified by flow cytometry. The measured MFI values were fitted to non-linear regression dose-response curve to determine EC50 values. The apparent EC50 values from these assays for PGT121 LO6 WT and representative PGT121 variants described herein are shown in FIG. 9, while FIG. 10 indicates the relative binding affinities.

Low pH Induced Aggregation

Figure 11:
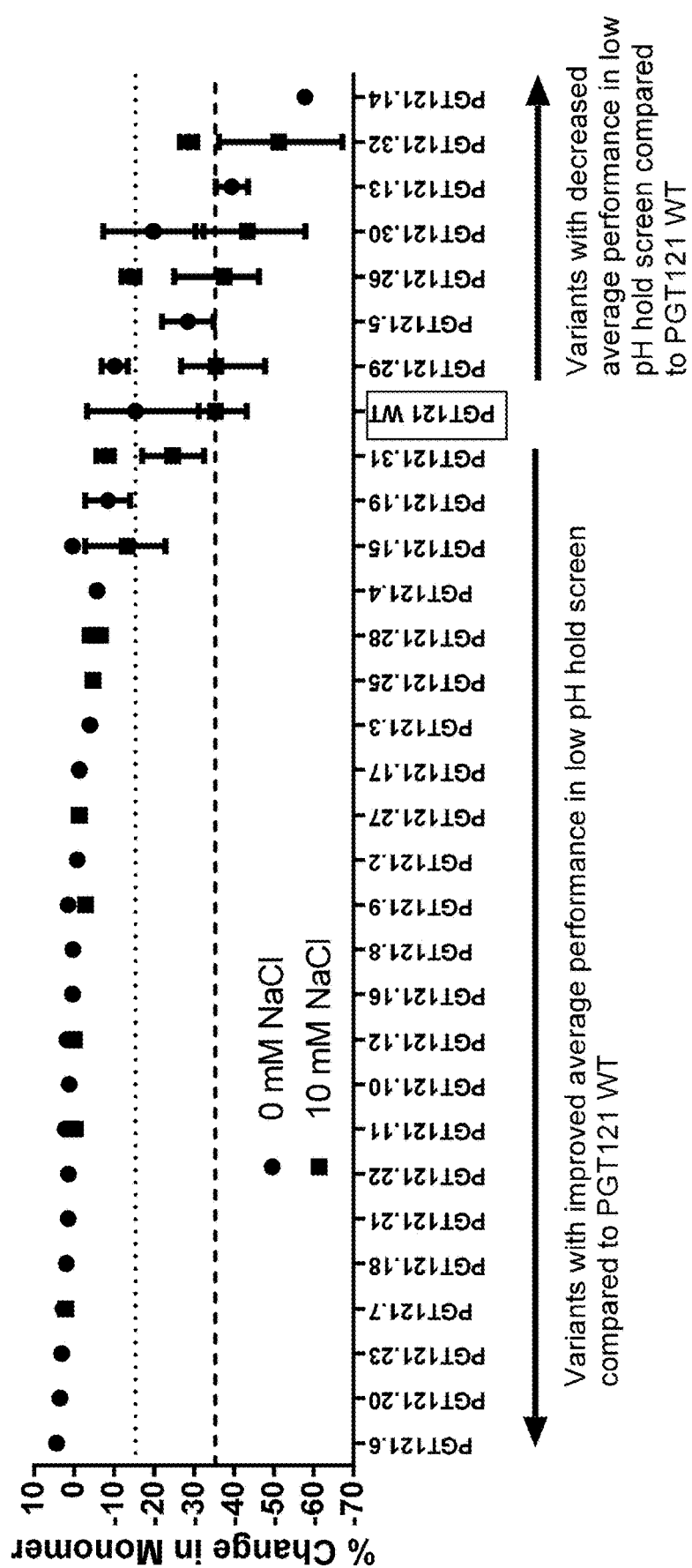
Figure 12:
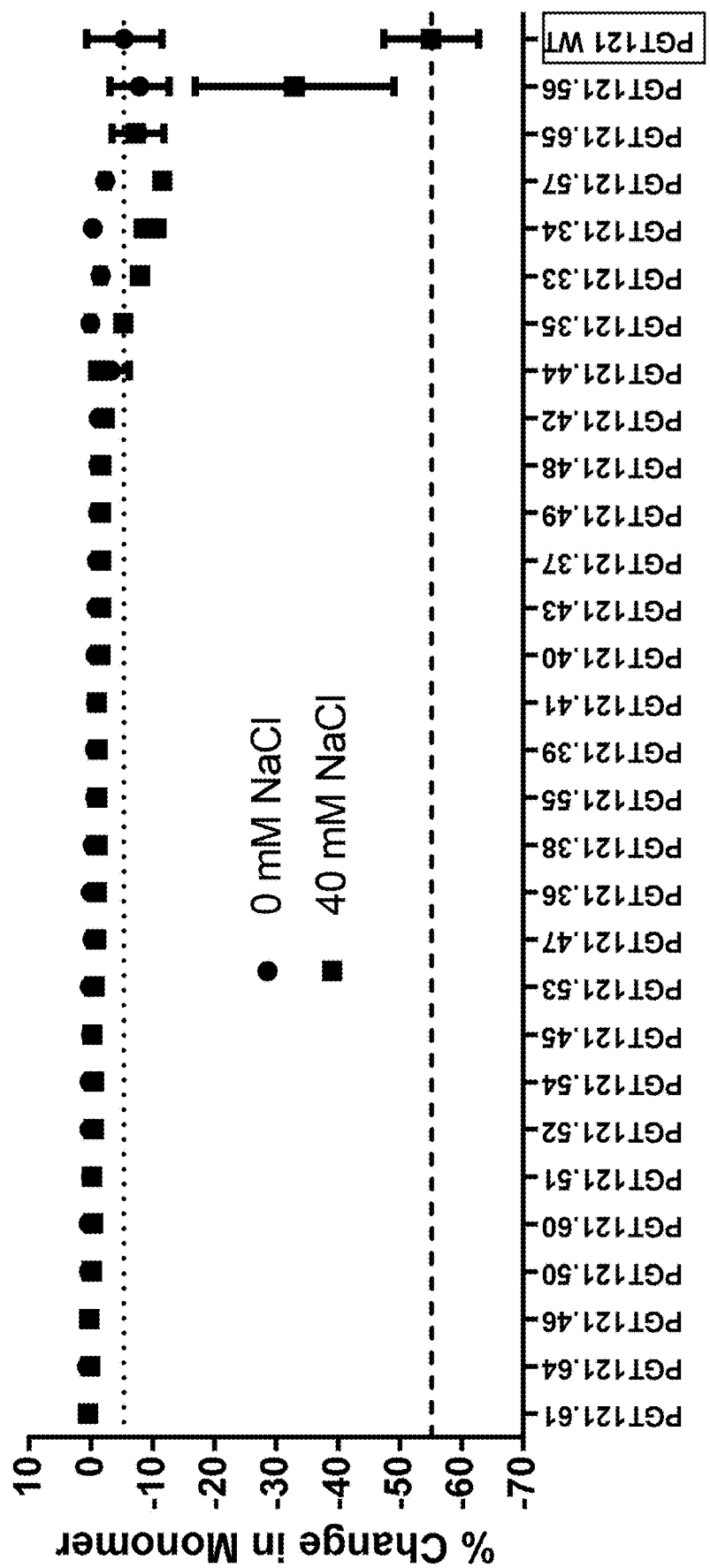
Figure 13:
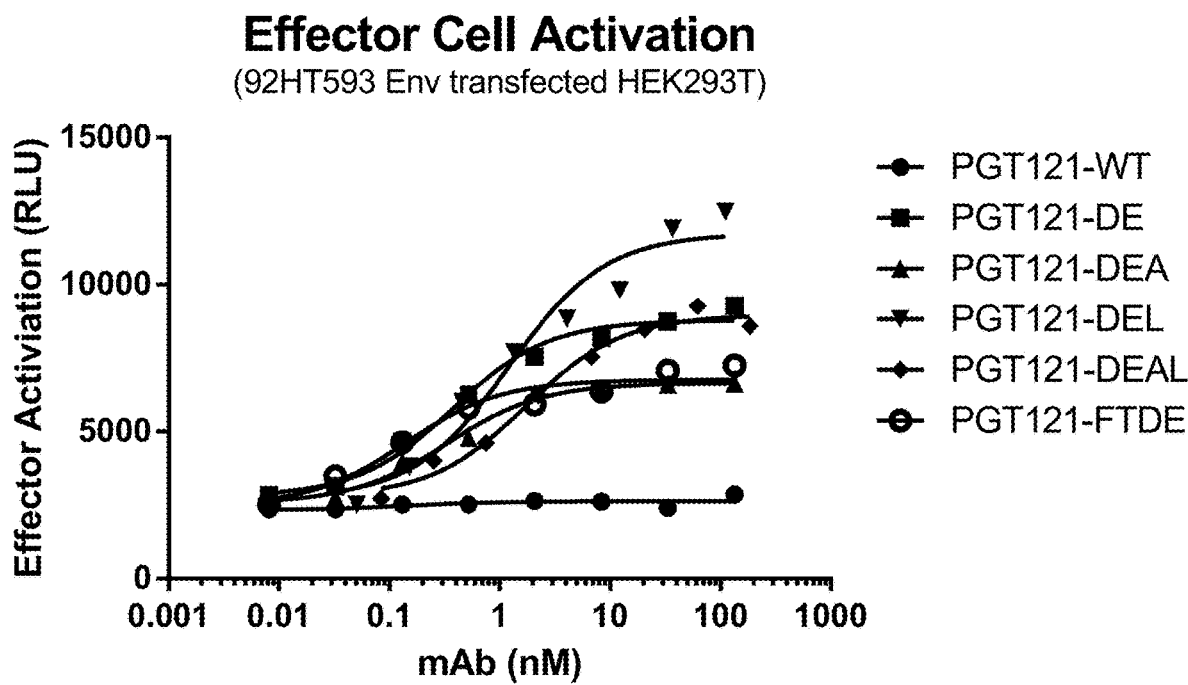
Figure 14:
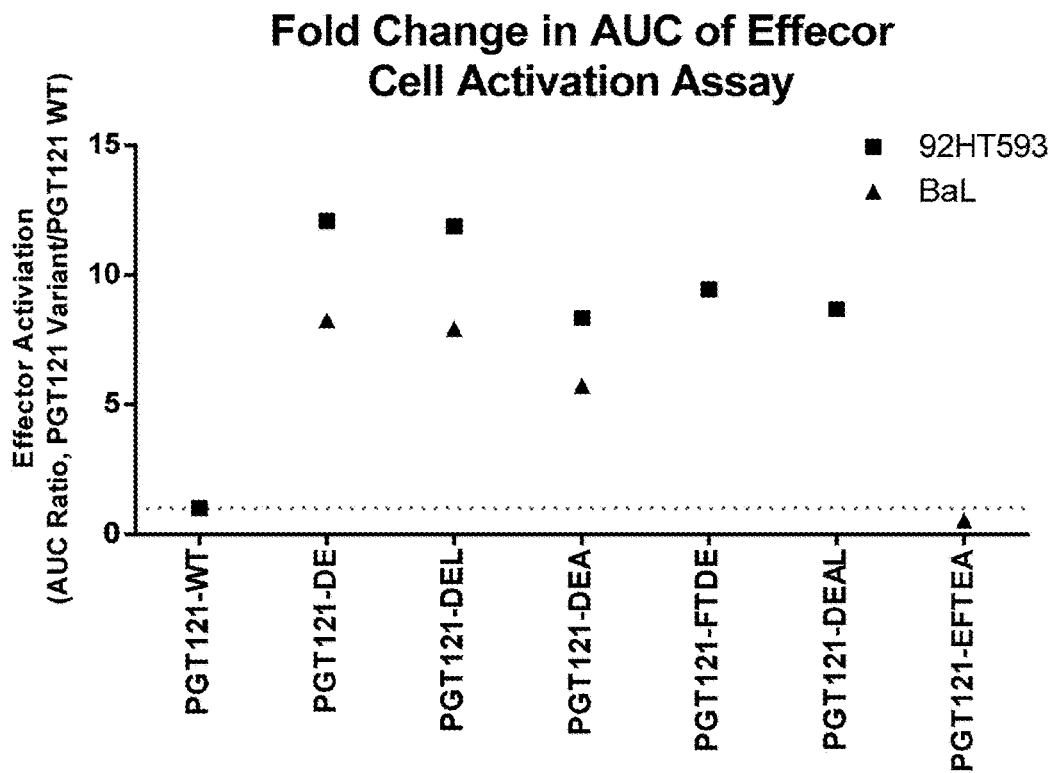
Figure 15:
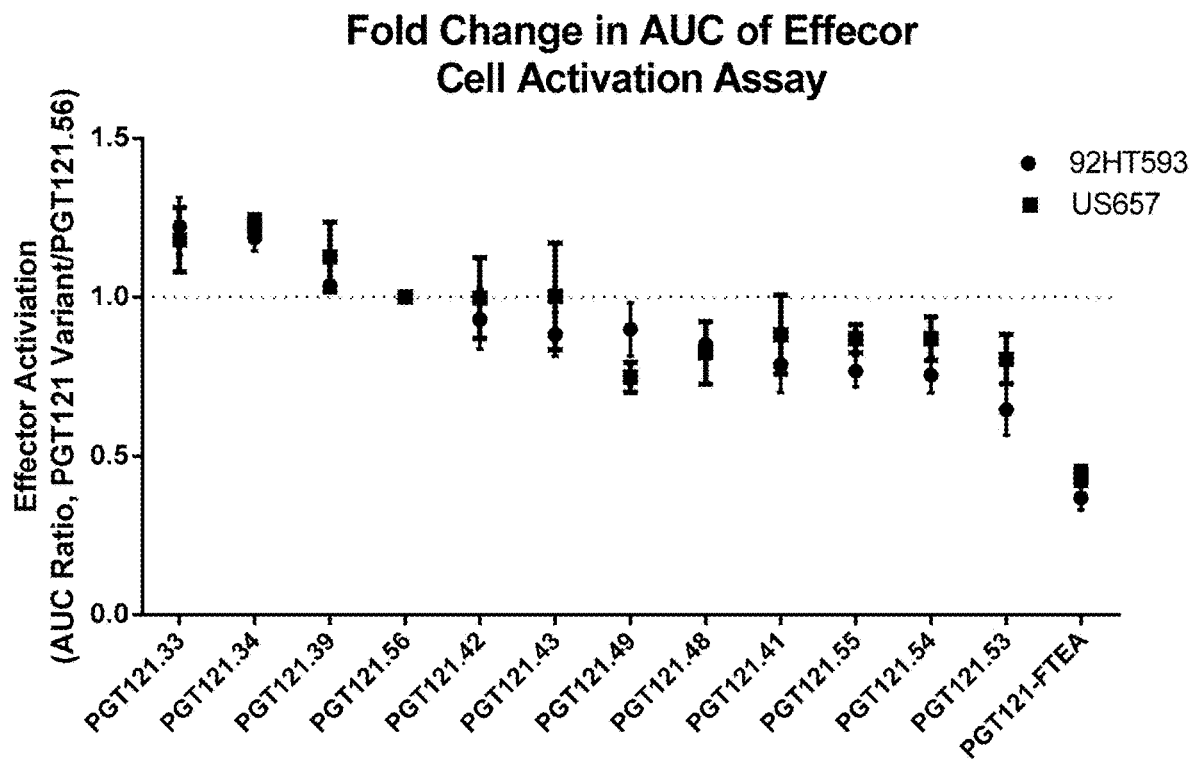
Figure 16:
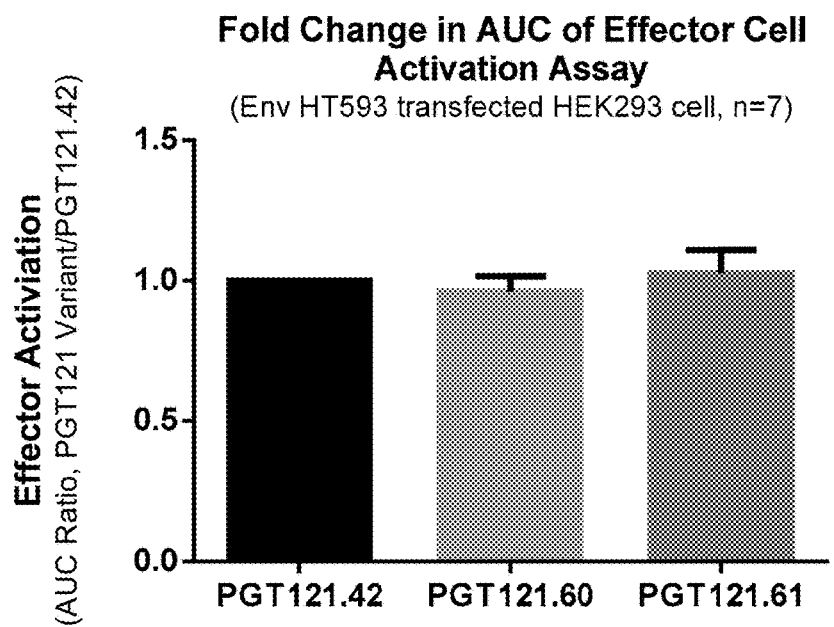

In order to screen for low pH induced protein aggregation, such as that induced by industrial viral inactivation procedures during antibody production, antibodies were held for 1 hour at pH 3.5 using two different procedures. In the first procedure, protein was first dialyzed into 25 mM NaOAc, with or without 10 mM NaCl pH 5, concentrated to 16 mg/mL, and then samples titrated to pH 3.5 with 0.5 M acetic acid with or without 10 mM NaCl and targeting a final protein concentration of 10 mg/mL. The sample was then incubated for 1 hour at room temp, neutralized to pH 5 with 2M Tris, held for an additional 2 hours at room temp and then analyzed by size exclusion chromatography (SEC). The results of the first procedure conducted on selected PGT121 mutants in the presence or absence or NaCl are shown in FIG. 11. In the second procedure, duplicate samples of antibody solution at 9 mg/mL in 20 mM Sodium Acetate pH 5.5, 9% sucrose are titrated to either 0 or 40 mM NaCl by addition of 10% v/v of 20 mM NaOAc, 9% Sucrose, 0.44M NaCl. Next, 0.5M acetic acid was added in the presence or absence of 40 mM NaCl until the target pH is 3.5, samples are incubated for 1 hour at room temperature, neutralized with 20% v/v 2M Tris base, held for an additional 2 hour at room temp and then analyzed by SEC. The percentage of monomer peak on SEC was analyzed before and after the low pH hold procedure and the change in monomer content is analyzed to identify antibody variants with increased aggregation/reduced monomer content. The results of the second procedure are shown in FIG. 12.

Antibody-Dependent Effector Cell Activation

The ability of the antibodies to activate Jurkat cells expressing human FcγRIIIA coupled to a NFAT luciferase reporter was determined using Env expressing HEK293 cells. Three Env sequences were employed for the reporter assays including 92HT593, 92US657 and BaL. The transfected cells were harvested 48 hours post transfection, and incubated with the antibodies and the described effector cells at 37 degree for 6 hours. The activation of the effector cells was represented and measured as luciferase signal. The collected data were fitted to non-linear regression dose-response curves, and the activity was quantified by area under the curve (AUC). The results are shown in FIG. 13-16. The activity of certain antibodies of the present invention was 10-fold enhanced over that of the PGT-121 antibody when quantified by area under the curve (AUC).

NK-Mediated Antibody-Dependent Cellular Cytotoxicity (ADCC)

Antibody-dependent killing by natural killer (NK) cells was assessed using a primary cell-based assay system with infected primary CD4+ T cells and purified autologous effector NK cells obtained from healthy donors. NK cells express the activating FcγR IIIA and mediate antibody-dependent killing of infected cells via granzyme- and perforin-mediated cytotoxicity (ADCC). To mimic the latent CD4+ T cell reservoirs, where cell surface antigen expression is predicted to be very low, target cells were generated by infecting quiescent primary CD4+ T cells by spinfection. In addition, to reproduce physiological conditions, ADCC was assessed in the presence of 10 mg/ml nonspecific human serum IgG which would compete with the effector Abs for FcγR binding. Antibody-dependent killing by NK cells was measured by the reduction in % p24 expressing $CD4^{low}$ T cells using flow cytometry.

Figure 17:
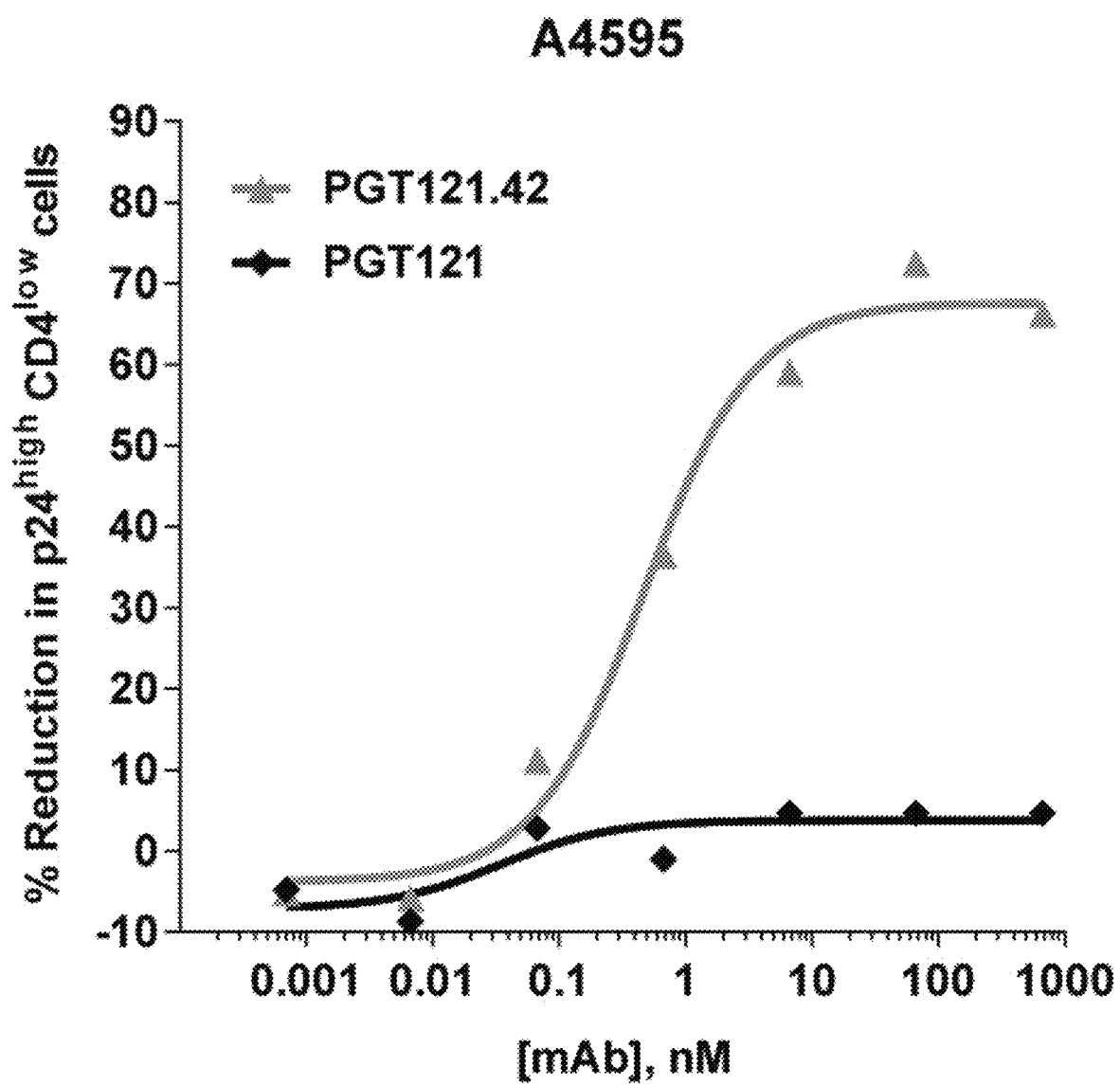
Figure 26:
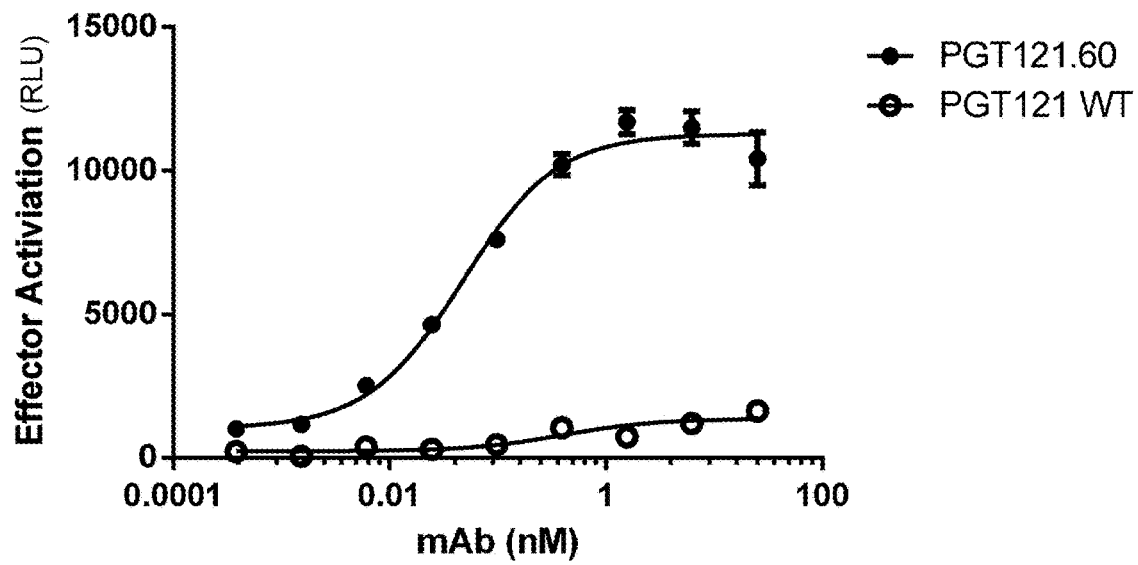
FIG. 26 is a graph showing effector cell activation by PGT121 (open circle) and the mutant PGT121.60 (closed circle) in the effector cell activation assay using Env HT593 transfected HEK293 cells.
Figure 27:
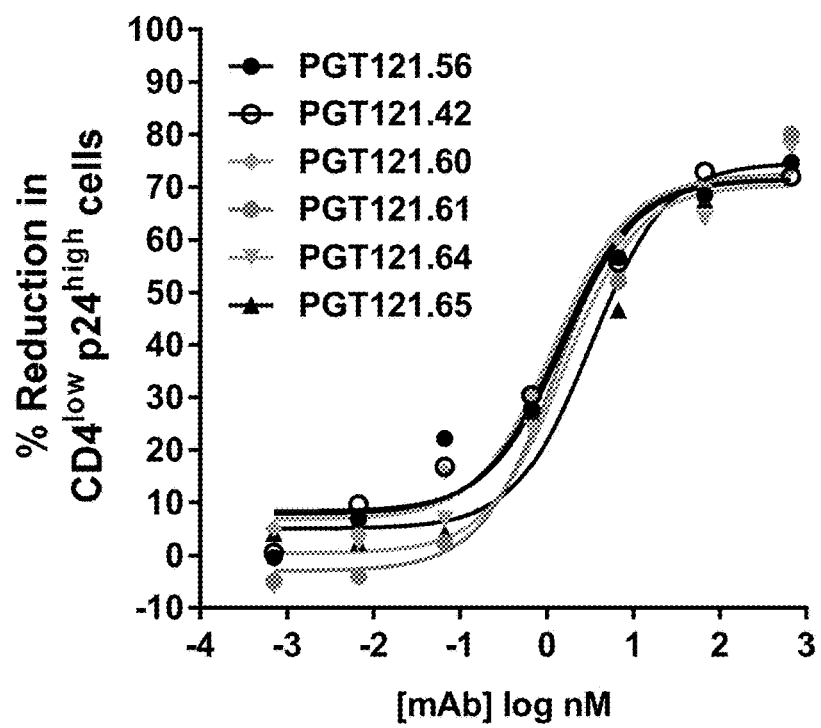
FIG. 27 is a graph showing ADCC activity of HIV-infected target CD4$^+$ T cells by a select set of PGT121 variants. Representative ADCC dose-response curves are shown for killing of primary CD4$^+$ T cells infected with viral isolate US657 by the effector enhanced PGT121 variants.
Figure 28:
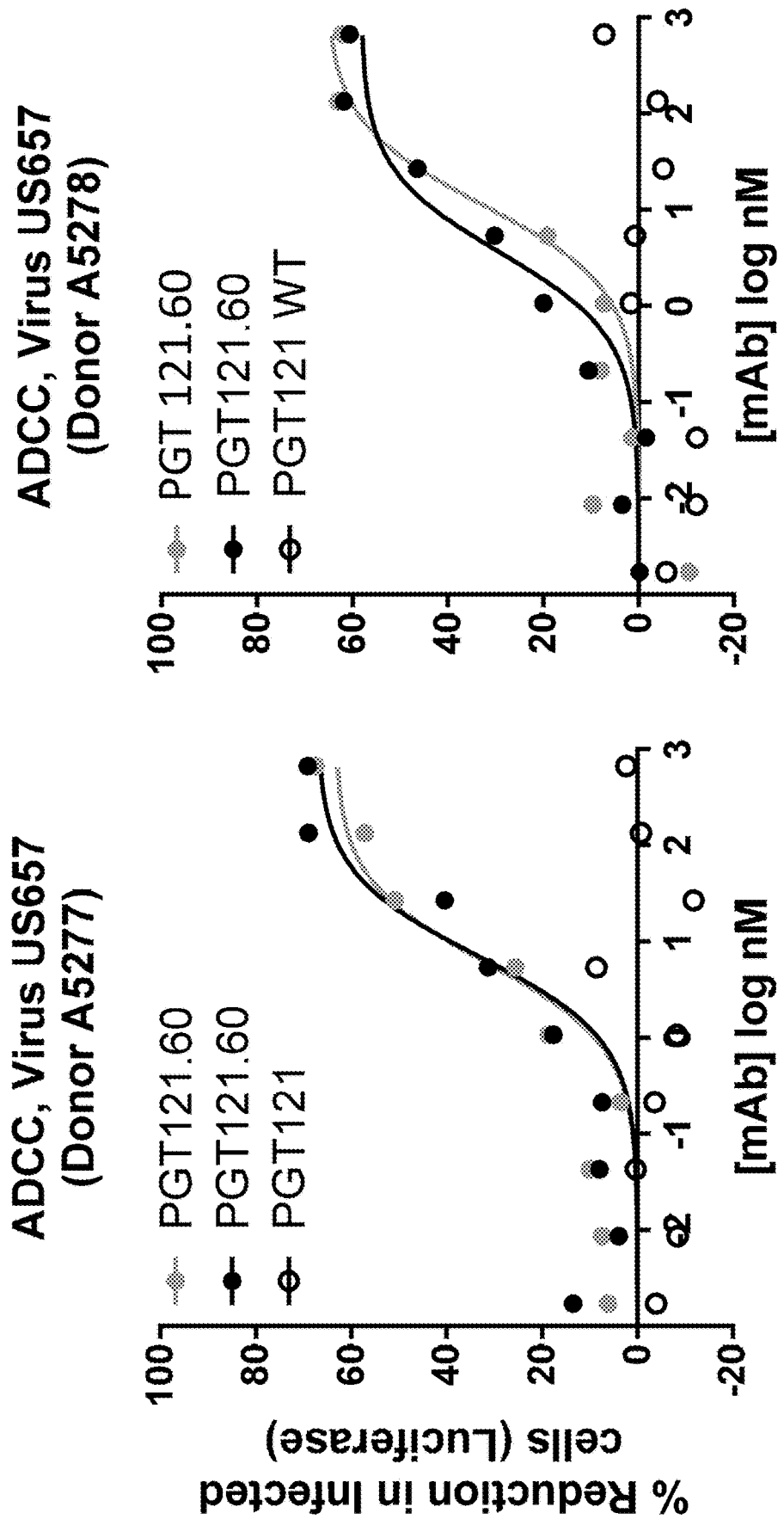
FIG. 28 is a graph showing enhanced ADCC activity of the PGT121 variant PGT121.60 in comparison to PGT121 in the presence of 5 mg/mL competing human serum IgG. Killing of the CEM.NKr.CCR5.Luc CD4 reporter cell line infected with HIV-1 isolate US657 as shown using primary human NK cells from two healthy donors.

PGT-121 mediated killing of infected CD4+ T cells in the absence of competing nonspecific serum IgG, but its overall magnitude of killing was substantially reduced by the presence of competing nonspecific serum IgG. In contrast, antibodies of the present invention mediated killing of US657-infected target cells in the presence of competing nonspecific IgGs. ADCC activity of certain antibodies was greater than 10-fold improved over that of PGT-121 as quantitated by calculated area under the curve (AUC) for the ADCC dose response. Similar levels of enhancement were observed when BaL-infected target cells were used. In the presence of competing nonspecific human serum IgG, antibodies of the present invention were more active than PGT121 due to their enhanced binding to the FcγRIIIs on the effector cells. These results are shown in FIG. 17 and Tables 9-11. In Table 9-11, the assays were performed in the presence of 10 mg/mL nonspecific human serum IgG. 1 μg/mL effector mAb=6.7 nM. Additional results are shown in FIGS. 26, 27, and 28 and Tables 20-21.

TABLE 9

Primary NK cell-mediated ADCC activity of PTG121.42 and PGT121 against CD4+ T cells infected with HIV-1 strain US657.

| | | PGT121.42 | | | PGT121 | | |
| --- | --- | --- | --- | --- | --- | --- | --- |
| Virus | Donor | $EC_{50}$ (nM) | $E_{max}$ (%) | AUC | $EC_{50}$ (nM) | $E_{max}$ (%) | AUC |
| US657 | A4595 | 0.57 | 68 | 211 | 42.6 | 9 | 13 |
| | A4588 | 4.3 | 68 | 154 | 96.3 | 20 | 17 |
| | A4589 | 1.5 | 78 | 201 | 3.0 | 5 | 13 |
| | A4838 | 0.94 | 45 | 114 | | | |
| | A4839 | 0.54 | 47 | 140 | | | |
| | A4813 | 1.4 | 72 | 222 | | | |
| | Geomean | 1.2 | 62 | 169 | 23 | 10 | 14 |
| | Range | 0.5-4 | 45-72 | 114-222 | 3-96 | 5-20 | 13-17 |

TABLE 10

Primary NK cell-mediated ADCC activity of PTG121.42 and PGT121 against CD4+ T cells infected with HIV-1 strain BaL

| | | PGT121.42 | | | PGT121 | | |
| --- | --- | --- | --- | --- | --- | --- | --- |
| Virus | Donor | $EC_{50}$ (nM) | $E_{max}$ (%) | AUC | $EC_{50}$ (nM) | $E_{max}$ (%) | AUC |
| BaL | A4590 | 1.2 | 71 | 273 | 1.2 | 16 | 53 |
| | A4591 | 0.02 | 58 | 281 | 239 | 27 | 57 |
| | A4838 | 0.5 | 59 | 174 | | | |
| | A4839 | 3.9 | 60 | 140 | | | |
| | A4813 | 4.4 | 75 | 216 | | | |
| | Geomean | 0.7 | 64 | 210 | 16.9 | 21 | 55 |
| | Range | 0.02-4.4 | 58-75 | 140-281 | | | |

TABLE 11

Primary NK cell-mediated ADCC activity of PTG121.42 and PGT121 against CD4+ T cells infected with HIV-1 strain HT593.

| | | PTG121.42 | | | PGT121 | | |
| --- | --- | --- | --- | --- | --- | --- | --- |
| Virus | Donor | $EC_{50}$ (nM) | $E_{max}$ (%) | AUC | $EC_{50}$ (nM) | $E_{max}$ (%) | AUC |
| HT593 | 1 | 0.024 | 75 | 391 | 0.24 | 40 | 217 |
| | X | 0.014 | 77 | 362 | 0.0001 | 48 | 289 |
| | A4588 | 0.176 | 70 | 253 | 1.36 | 18 | 48 |
| | A4589 | 0.18 | 70 | 264 | 0.93 | 18 | 46 |
| | A4838 | 0.62 | 44 | 125 | | | |
| | A4839 | 5.2 | 58.5 | 114 | | | |
| | A4813 | 4.9 | 71 | 191 | | | |
| | Geomean | 0.3 | 65.5 | 221.0 | 0.1 | 28.1 | 108.5 |
| | Range | 0.01-5.2 | 44-77 | 114-391 | 0.00012-1.4 | 18-48 | 45-290 |

Monocyte- and PBMC-mediated Antibody-Dependent Cell Killing

The ability of antibodies to mediate antibody-dependent cell killing was investigated in vitro using HIV-1-infected primary resting CD4+ T cells as target cells, and primary autologous PBMCs or isolated monocytes as effector cells. PBMCs, in particular CD14+ monocytes and CD56+ NK cells, express the activating FcγRs I, IIA and IIIA and can mediate antibody-dependent killing of infected cells via phagocytosis (antibody-dependent cellular phagocytosis; ADCP) and granzyme- and perforin-mediated cytotoxicity (ADCC). The target CD4+ T cells, primary CD14+ monocyte effector cells and PBMCs used in the assays were obtained from healthy donors.

Figure 18B:
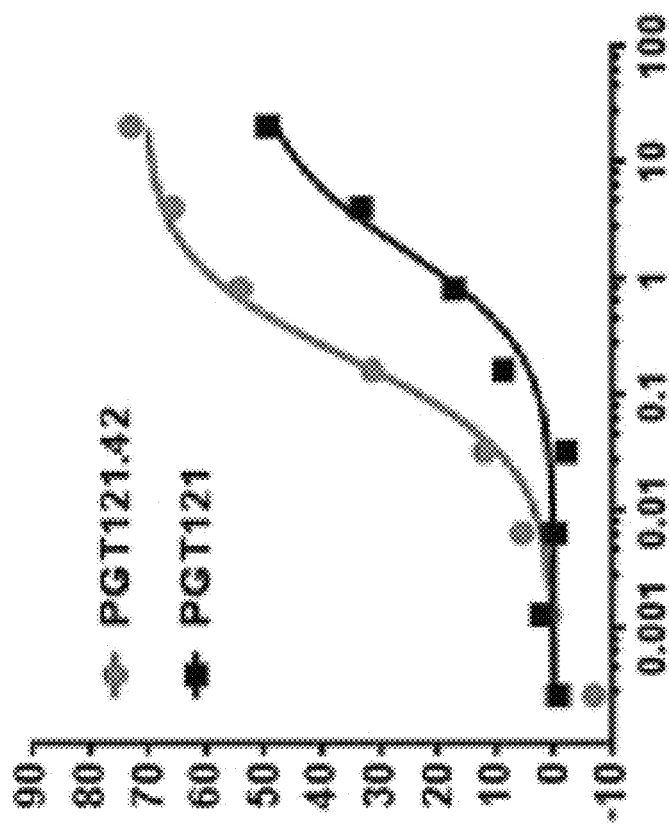
Figure 18A:
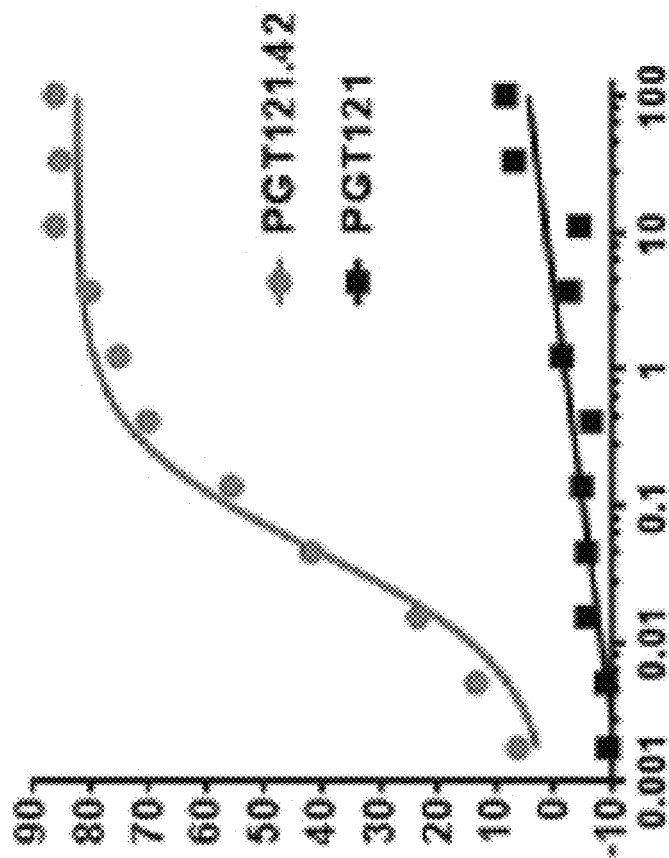
Figure 19A:
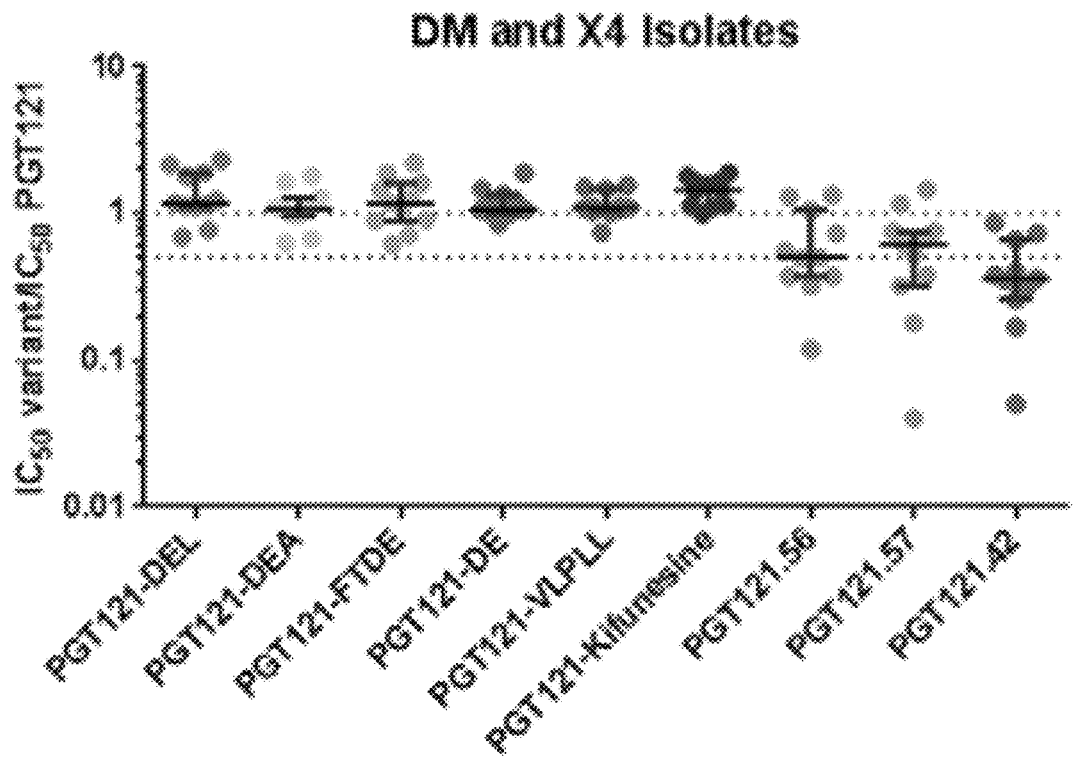
Figure 19B:
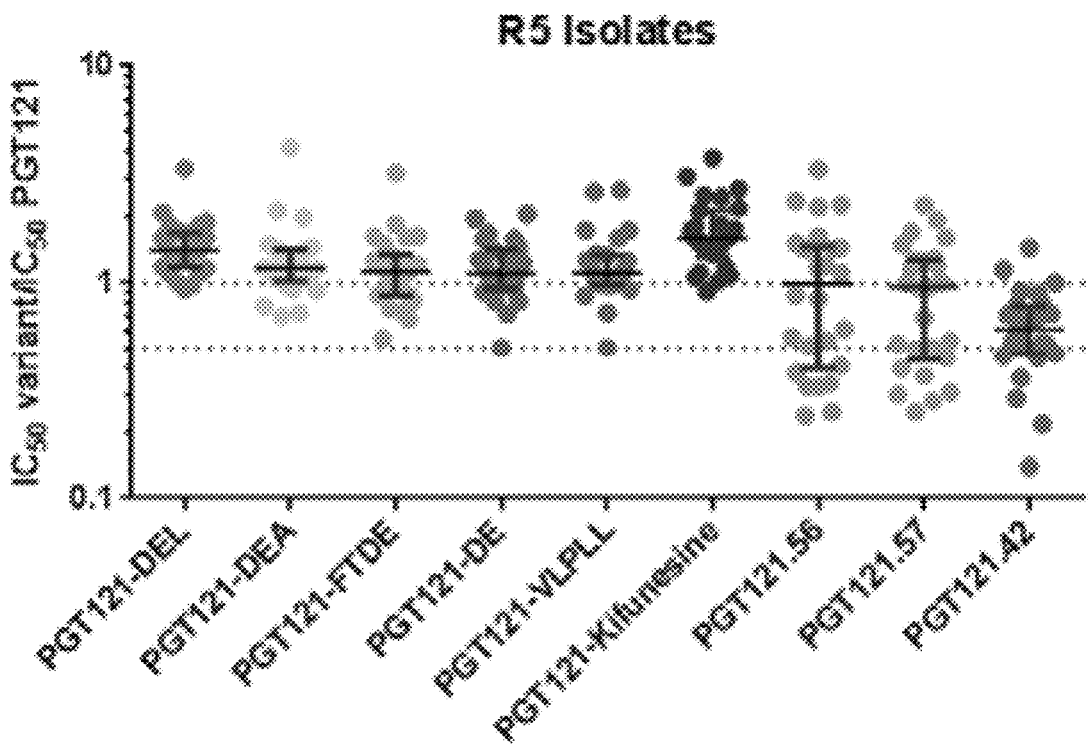

Antibodies of the invention exhibited significantly improved monocyte-mediated killing of HIV-1-infected CD4 T cells compared to PGT-121 in two donors infected in vitro with two independent viral isolates, and was significantly more effective than PGT-121. They also exhibited significantly improved potency and maximum killing of HIV-1-infected cells compared to PGT-121 in the PBMC effector assay in four donors examined using the viral isolate, US657. For two donors, they exhibited killing where PGT-121 was inactive. In the other two donors, they showed a higher Emax that PGT-121. The improvement in potency observed ranged from about 2- to 25-fold for the donors in which PGT-121 was active to >2000 for the donors in whom PGT-121 was inactive. Data is shown in FIG. 18 and Tables 12, 24 and 25.

TABLE 12

Parameters for monocyte- and PBMC-mediated PGT121.42-dependent cell killing

| Effector cells | Donor | Virus | EC$_{50}$ (nM) PGT121 | EC$_{50}$ (nM) PGT121.42 | E$_{max}$ (%) PGT121 | E$_{max}$ (%) PGT121.42 |
|---|---|---|---|---|---|---|
| Monocytes | A4169 | US657 | 15.2 | 1.2 | 56.5 | 72.0 |
|  | A4169 | HT593 | 10.2 | 1.5 | 49.5 | 64.2 |
|  | A4168 | US657 | 11.8 | 1.2 | 52.2 | 70.9 |
|  | A4168 | HT593 | 8.8 | 0.6 | 51.2 | 65.4 |
| PBMCs | A4614 | US657 | >134 | 0.3 | 8.3 | 82.5 |
|  | A4615 | US657 | >134 | 0.1 | 5.9 | 82.8 |
|  | A4616 | US657 | 1.9 | 0.8 | 48.1 | 76.1 |
|  | A4617 | US657 | 5.4 | 0.2 | 58.3 | 75.4 |

Virus Neutralization Activity

PGT121 is a highly potent neutralizing antibody with broad coverage of HIV subtype B isolates (IC50 0.03 μg/ml, 80% breadth). The Env-based binding studies described herein demonstrated comparable activity of PGT-121 and antibodies of the present invention. The potency (measured as IC50 or IC95) and breadth (% of isolates neutralized from the panel tested) of neutralization of PGT121 and its variants was examined using two different published assay formats: i) the CEM-NKr-CCR5-Luc reporter cell-line based assay (Li et al. 2005. J Vir 79(16): 10108-10125), which is compatible for screening antibodies against pseudotyped as well as replication competent HIV isolates; and ii) the Monogram HIV PhenoSense Neutralization Assay (Monogram Biosciences) which uses a luciferase reporter virus pseudotyped with HIV Env variants of interest (Richman et al. 2003. PNAS 100(7): 4144-4149). In the reporter cell-line-based CEM-NKr-CCR5-LucR neutralization assay, a multicycle viral replication assay (Spenlehauer et al. 2001. Virology, doi:10.1006/viro.2000.0780), antibodies were screened against a panel of five replication competent clinical isolates including the lab adapted HIV-1 BaL strain and subtype B isolates 93HT593, 92US657, 92US712 and 92US727 amplified from patient plasma samples (NIH AIDS Reagent Program).

Neutralization potency of the antibodies of the invention was observed to be comparable to that of PGT-121 for the five viruses tested, suggesting that the modification present in these antibodies as compare to PGT-121 had minimal impact on the determinants of antigen recognition and binding (Table 13 below with the CEM-NKr-CCR5-Luc cells). Other variants (e.g. PGT121.60, PGT121.61) exhibited a 2-3 fold increase in neutralization potency against this limited virus panel compared to PGT121.

In the Monogram neutralization assay, the Env (gp160) coding region is amplified from plasma viral RNA isolated from HIV+ART naïve viremic patients and cloned into an expression vector, such that the virus quasispecies distribution present in the patient plasma samples is maintained. The expression vectors are then used to generate HIV-1 pseudovirus swarms expressing the patient-derived Env proteins. Two panels of clade B clinical isolates were generated for the Monogram neutralization assay: Panel 1 (Monogram clinical isolates panel) comprised 63 isolates from the Monogram library collection, and included 33 or more CCR5-tropic viruses, 15 or more CXCR4-tropic (X4) and 15 or more viruses of dual-mixed (DM) tropism; and Panel 2 (Gilead clinical isolates panel) comprised 142 subtype B viruses isolated from pre-ART baseline plasma samples from ART naïve HIV patients enrolled in clinical trials and included 113 CCR5-tropic (R5) viruses, 28 viruses of dual or mixed-tropism (DM) and one CXCR4 tropic (X4) virus. Given that HIV-1 Env exhibits significant diversity among patient isolates, between clades, as well as within a clade, neutralization activity of PGT121 and variants was also profiled against viruses representing non-B clades using a panel of viruses from Monogram's library collection. The Monogram HIV PhenoSense Neutralization Assay was utilized to profile large collections of patient isolates, thereby enabling a more rigorous profiling of both breadth and potency of PGT121 and the variants generated. The results are shown in FIGS. 19-21, 29-30 and Tables 22-25. Results showed that variants of PGT121 such as PGT121.60 showed enhanced neutralization activity against select viruses.

These experiments demonstrated an unexpected improvement in X4-tropic HIV neutralization by Fc enhanced PGT121. HIV can utilize two co-receptors in addition to CD4 for entry into T cells—either CXCR4 or CCR5. The co-receptor binding is mediated by Env, the target of the

TABLE 13

Neutralization activity of PGT121, and select variants against HIV-1 strains BaL, HT593, US657, US712 and US727, as observed using the CEM.NKr.CCR5.Luc based assay. Data represents mean of 2 to 3 repeats

Figure 29A:
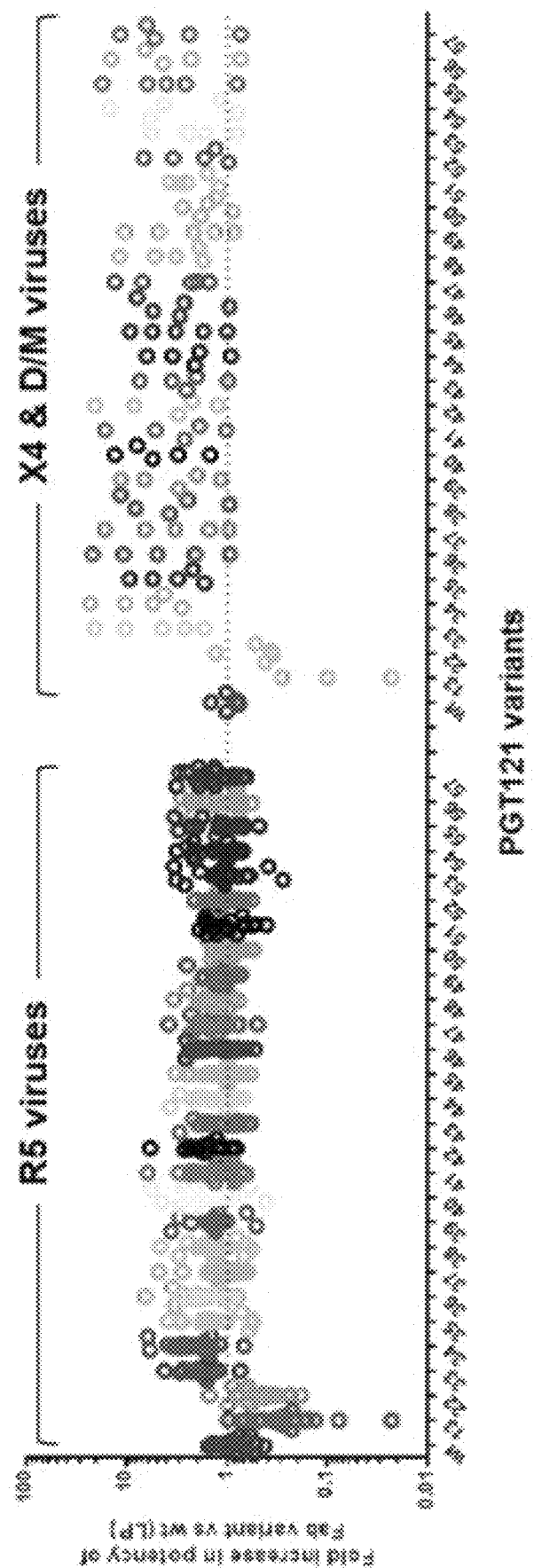
FIGS. 29A and 29B show the increased potency of PGT121 variants against R5, X4 and D/M viruses.
Figure 29B:
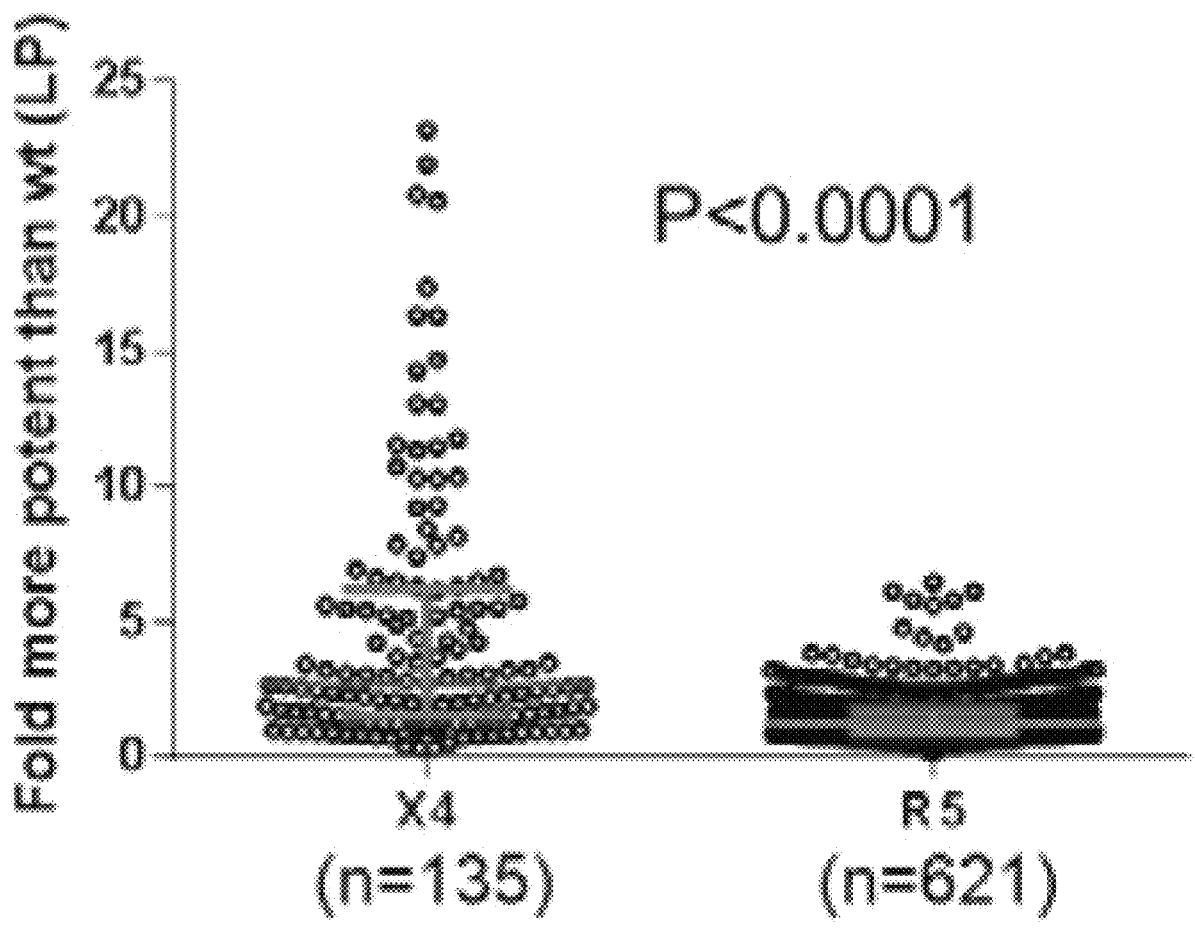

| mAb | Neutralization Potency, IC$_{50}$ (μg/mL) BaL | HT593 | US657 | US712 | US727 | PGT121 IC$_{50}$/Variant IC$_{50}$ BaL | HT593 | US657 | US712 | US727 |
|---|---|---|---|---|---|---|---|---|---|---|
| PGT121 | 0.020 | 0.216 | 0.111 | 0.017 | 0.013 | 1 | 1 | 1 | 1 | 1 |
| PGT121.42 | 0.015 | 0.155 | 0.096 | 0.020 | 0.015 | 1.3 | 1.4 | 1.2 | 0.9 | 0.9 |
| PGT121.43 | 0.013 | 0.127 | 0.092 | 0.016 | 0.012 | 1.5 | 1.7 | 1.2 | 1.1 | 1.1 |
| PGT121.56 | 0.02 | 0.164 | 0.142 | 0.019 | 0.011 | 1.0 | 1.3 | 0.8 | 0.9 | 1.2 |
| PGT121.60 | 0.007 | 0.141 | 0.062 | 0.008 | 0.007 | 2.9 | 1.5 | 1.8 | 2.1 | 1.9 |
| PGT121.61 | 0.008 | 0.343 | 0.072 | 0.008 | 0.005 | 2.5 | 0.6 | 1.5 | 2.1 | 2.6 | broadly neutralizing antibodies described herein. Different strains of HIV with different sequences thus preferentially use CXCR4 (known as X4-tropic), CCR5 (known as R5-tropic) or both (known as X4/R5 or dual-tropic). Virus pools showing both R5 and X4 tropism (referred to as Dual-Mixed or DM) may contain mixtures of R5, X4 and or dual tropic strains. PGT121 generally shows poor sensitivity (low potency and breadth) against X4 isolates, preferentially neutralizing R5 tropic viruses. Addition of the Fc mutations DEAL+LS into PGT121 (PGT121.56) specifically enhanced its neutralization activity against DM and X4 tropic viruses (median $IC_{50}$ enhancement of 2-fold and up to about 20-fold enhancement for at least one isolate. While some PGT121 Fab variants (e.g. PGT121.13 and PGT121.22) exhibited reduced neutralization potency against R5 DM and X4 viruses, several of the engineered PGT121 Fab variants carrying the DEAL+LS Fc mutations, including PGT121.56 with the WT Fab were more potent at neutralizing DM and X4 viruses compared to R5 viruses (P<0.0001) (FIG. 29A-29B). This is highly unexpected as HIV neutralization is thought to be mediated exclusively by the Fab domain rather than the Fc domain. Among R5 isolates, a 2- to 3-fold enhancement in neutralization was observed in about 46% of isolates tested. The DEAL+LS mutation is present in certain antibodies and fragments thereof of the present invention. Additional modifications introduced to PGT121.56 further improved neutralization activity of select variants (PGT121.42, PGT121.60, etc.) but not necessarily all.

Figure 20:
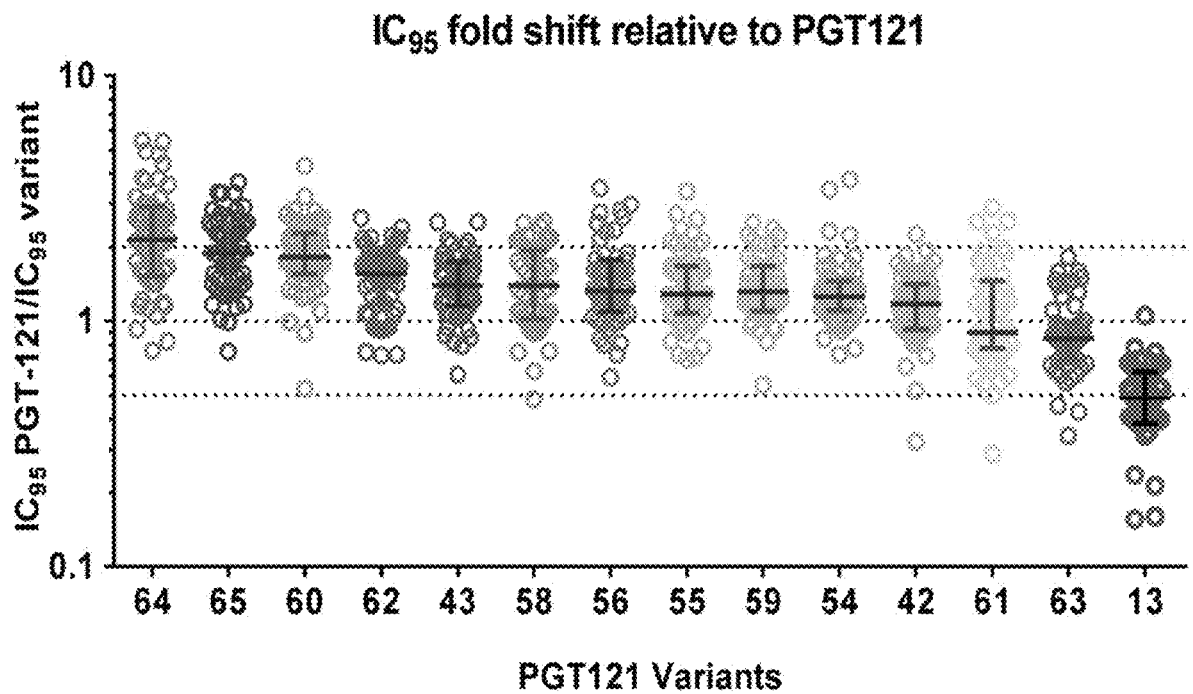
Figure 21:
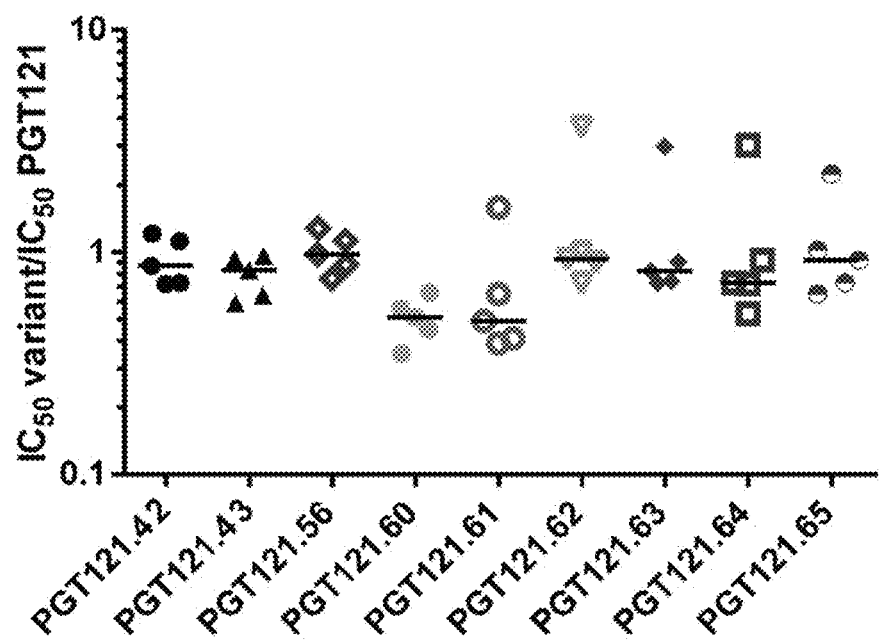

Breadth of coverage was calculated as the percentage of viruses neutralized at an $IC_{95} \leq 15$ µg/ml. Potency was determined by calculating median IC95 values across viruses with $IC_{95} \leq 15$ µg/ml (FIG. 20 and Table 24). When tested against both panels of HIV-1 isolates, comprising 89 clade B isolates in total, antibodies of the present invention exhibited no loss in neutralization activity compared to PGT121 (data not shown). Potency of certain antibodies was near identical to PGT121, with a slightly improved neutralization breadth. The neutralization profiling also served as a surrogate assessment of the ability of the antibodies relative to PGT-121 to recognize and bind diverse Env antigens from a wide range of HIV-1 clinical isolates. Data from profiling of various antibodies showed that antibodies with reduced neutralization potency also exhibited reduced ADCC activity (data not shown), suggesting a positive correlation between the neutralization activity and ADCC activity of the antibodies, and supporting the use of neutralization breadth as a surrogate for the assessment of ADCC breadth.

Immunogenicity

Three methods were used to assess immunogenicity and guide engineering to remove immunogenic motifs in PGT121. In silico prediction tools were used to identify sites of potential risk of immunogenicity in the PGT121 antibody, and also to guide engineering efforts to improve manufacturability (e.g. removal of glycosylation sites, improvement of low pH hold stability) while preventing introduction of novel T cell epitopes. Based on this analysis, modification of the framework regions were made in antibodies of the present invention to reduce immunogenicity which had a low risk of impacting functional activity. In addition, to further identify potentially immunogenic motifs within the variable domain of one antibody of the present invention, an ex vivo human T cell activation assay, (EPISCREEN™, Antitope, Ltd., Cambridge, UK) was employed. CD4+ T cells responses induced in 50 healthy donors, representing a variety of HLA haplotypes, in response to overlapping 15 amino acid peptides derived from the antibody, and KLH (keyhole limpet hemocyanin, positive control) were assessed using H-thymidine incorporation assay to measure T-cell proliferation. The assay enabled the localization of specific T cell epitopes in the primary antibody sequence to guide antibody engineering. It also provided a ranking of the relative immunogenicity of T cell epitopes with tested antibodies. The predicted or actual immunogenic epitopes identified in these assays are shown in Tables 14-16 (in silico prediction of T-cell epitopes is shown in grey and amino acid variants designed to reduce T-cell epitope is shown in white). The data using donor cells shows that certain mutations reduce immunogenicity in these assays, while others do not.

TABLE 14

In silico prediction of T-cell epitopes in PGT-121 LO6 HC and amino acid variants designed to reduce T-cell epitope content in the PGT-121 LO6 HC

| SEQ ID NO | Epitope # | Epitope Sequence | #HLA Alleles Predicted to Bind (1out of 34 total tested) | #HLA Alleles Predicted to Bind with High Affinity (out of 34 total tested) | TCED Database Blast Hit? | Antitope iTope Risk Level |
|---|---|---|---|---|---|---|
| 63 | 121-HC-1 | MQLQESGPG | 25 | 14 | No | moderate |
| 64 | 121-HC-1.1 | VQLQESGPG | 25 | 14 | No | low |
| 65 | 121-HC-1.2 | VHLQESGPG | 21 | 8 | No | moderate |
| 66 | 121-HC-1.3 | LHLQESGPG | 21 | 8 | No | moderate |
| 67 | 121-HC-2 | VSGASISDS | 21 | 3 | No | moderate |
| 68 | 121-HC-2.1 | VSGGSISDS | 11 | 8 | No | low |
| 69 | 121-HC-2.2 | VSGASISDA | 7 | 0 | No | low |
| 70 | 121-HC-2.3 | VSGGSISDA | 7 | 1 | No | low |
| 71 | 121-HC--2.4 | VSGTLVRON | 5 | 1 | No | low |
| 72 | 121-HC-2.5 | VSGASINDA | 14 | 0 | No | low |
| 73 | 121-HC-2.6 | VSGGSISNY | 6 | 1 | No | low |

TABLE 14-continued

In silico prediction of T-cell epitopes in PGT-121 L06 HC and amino acid variants designed to reduce T-cell epitope content in the PGT-121 L06 HC

| SEQ ID NO | Epitope # | Epitope Sequence | #HLA Alleles Predicted to Bind (1out of 34 total tested) | #HLA Alleles Predicted to Bind with High Affinity (out of 34 total tested) | TCED Database Blast Hit? | Antitope iTope Risk Level |
|---|---|---|---|---|---|---|
| 74 | 121-HC-2.7 | VSNGSVSGR | 10 | 5 | No | low |
| 75 | 121-HC-3 | IRRSPGKGLL | 23 | 13 | No | moderate |
| 76 | 121-HC-3.1 | IRQSPGKGL | 17 | 4 | No | low |
| 77 | 121-HC-3.2 | IRQPLGKQP | 2 | 1 | No | low |
| 78 | 121-HC-3.3 | IRQSPGKRP | 9 | 2 | No | low |
| 79 | 121-HC-3.4 | IRQSPGRGL | 17 | 8 | No | low |
| 80 | 121-HC-4 | IGYVHKSGD | 17 | 6 | No | moderate |
| 81 | 121-HC-4.1 | IGYVHDSGD | 2 | 2 | No | low |
| 82 | 121-HC-4.2 | VGYVHHSGD | 5 | 4 | No | low |
| 83 | 121-HC-4.3 | IGYISDRET | 4 | 1 | No | low |
| 84 | 121-HC-4.4 | IGYFSDTDR | 7 | 0 | No | low |
| 85 | 121-HC--5 | LKSRVNLSL | 23 | 14 | No | moderate |
| 86 | 121-HC-5.1 | LKSRVTLSL | 29 | 22 | No | high |
| 87 | 121-HC-5.2 | LKSRVHLSL | 21 | 16 | No | moderate |
| 88 | 121-HC-5.3 | LKSRVSLSL | 23 | 19 | No | high |
| 89 | 121-HC-5.4 | LKSRVALSL | 23 | 20 | No | high |
| 90 | 121-HC-5.5 | LKRRVTFSL | 30 | 21 | No | high |
| 91 | 121-HC-5.6 | LNSRAVISR | 20 | 14 | No | moderate |
| 92 | 121-HC-5.7 | LRSRLTLSV | 33 | 31 | No | high |
| 93 | 121-HC-6 | VSLSLVAAT | 22 | 4 | No | moderate |
| 94 | 121-HC-6.1 | VSLKLVAAT | 17 | 13 | No | moderate |
| 95 | 121-HC-6.2 | VSLSLTSVT | 14 | 5 | No | low |
| 96 | 121-HC-6.3 | VSLSLSSVT | 21 | 9 | No | moderate |
| 97 | 121-HC-6.7 | VSLSLKSVT | 20 | 12 | No | moderate. |
| 98 | 121-HC-6.4 | VSLSLNSVT | 26 | 12 | No | moderate |
| 99 | 121-HC-6.8 | VSLKLTSVT | 15 | 6 | No | low |
| 100 | 121-HC-6.9 | VSLRLTGVT | 9 | 5 | No | low |
| 101 | 121-HC-6.10 | VSLKLVOLT | 8 | 4 | No | low |
| 102 | 121-HC-6.11 | LSLQLRSVT | 8 | 1 | No | low |
| 103 | 121-HC-6.12 | LSLRLKSVT | 9 | 6 | No | low |
| 104 | 121-HC-6.13 | LSLKLKSVT | 12 | 8 | No | low |
| 105 | 121-HC-7 | LVAATAADS | 32 | 31 | No | high |
| 106 | 121-HC-7.1 | LTSVTAADS | 23 | 13 | No | moderate |
| 107 | 121-HC-7.2 | LTGVTAADS | 23 | 13 | No | moderate |
| 108 | 121-HC-7.3 | LRSVTAADS | 34 | 31 | No | high |

TABLE 14-continued

In silico prediction of T-cell epitopes in PGT-121 L06 HC and amino acid variants designed to reduce T-cell epitope content in the PGT-121 L06 HC

| SEQ ID NO | Epitope # | Epitope Sequence | #HLA Alleles Predicted to Bind (1out of 34 total tested) | #HLA Alleles Predicted to Bind with High Affinity (out of 34 total tested) | TCED Database Blast Hit? | Antitope iTope Risk Level |
|---|---|---|---|---|---|---|
| 109 | 121-HC-7.4 | LKSVTAADS | 31 | 24 | No | high |
| 110 | 121-HC-7.5 | LNSVTAADS | 31 | 21 | No | high |
| 111 | 121-HC-7.6 | LSSVTAADS | 19 | 9 | No | moderate |
| 112 | 121-HC-7.7 | LVDLTAADS | 31 | 24 | No | high |
| 113 | 121-HC-7.8 | LRSVTTADT | 34 | 30 | No | high |
| 114 | 121-HC-7.9 | LKSVTAADS | 31 | 24 | No | high |
| 115 | 121-HC-8 | YYCARTLHG | 20 | 15 | No | moderate |
| 116 | 121-HC-8.1 | YYCATTKHG | 16 | 12 | No | low |
| 117 | 121-HC-8.2 | YFCARALHG | 19 | 11 | No | moderate |
| 118 | 121-HC-8.3 | YFCATARRG | 11 | 7 | No | low |
| 119 | 121-HC-8.4 | YYCARAQQG | 12 | 3 | No | low |
| 120 | 121-HC-9 | LHGRRIYGI | 23 | 15 | No | moderate |
| 121 | 121-HC-9.1 | KHGRRIYGV | 0 | 0 | No | low |
| 122 | 121-HC-9.2 | LHGKRIYGI | 21 | 15 | No | moderate |
| 123 | 121-HC-9.3 | RRGQRIYGV | 0 | 0 | No | low |
| 124 | 121-HC-9.4 | QQGKRIYGI | 0 | 0 | No | low |
| 125 | 121-HC-10 | IYGIVAFNE | 21 | 12 | No | moderate |
| 126 | 121-HC-10.1 | IYGVVAFKE | 16 | 11 | No | low |
| 127 | 121-HC-10.2 | IYGIVALGE | 23 | 17 | No | high |
| 128 | 121-HC-10.3 | IYGVVSFGE | 17 | 10 | No | moderate |
| 129 | 121-HC-10.4 | IYGIVSFGE | 22 | 14 | No | moderate |
| 130 | 121-HC-11 | YFYMDVWGN | 19 | 15 | No | moderate |
| 131 | 121-HC-11.1 | YFYMDVWGK | 18 | 17 | Yes | high |
| 132 | 121-HC-11.2 | YFYMDVWDQ | 19 | 17 | Yes | high |
| 133 | 121-HC-11.3 | YFYMDVWGA | 20 | 19 | No | high |
| 134 | 121-HC-11.4 | YFYMDVWGH | 20 | 17 | No | high |
| 135 | 121-HC-11.5 | YFYMDVWGR | 20 | 17 | Yes | high |
| 136 | 121-HC-11.6 | YFYMDVWGT | 20 | 18 | No | high |
| 137 | 121-HC-11.7 | YYYMDVWGK | 18 | 17 | Yes | high |
| 138 | 121-HC-11.8 | YYYMDAWGK | 17 | 13 | Yes | moderate |

TABLE 15

In silico prediction of T-cell epitopes in PGT-121 L06 LC and amino acid variants designed to reduce T-cell epitope content in the PGT-121 L06 LC.

| SEQ ID NO | Epitope # | Epitope Sequence | #HLA Alleles Predicted to Bind (out of 34 total tested) | #HLA Alleles Predicted to Bind with High Affinity (out of 34 total tested) | TCED Database Blast Hit? | Antitope iTope Risk Level |
|---|---|---|---|---|---|---|
| 139 | 121-LC-1 | VAPGETARI | 19 | 11 | No | moderate |
| 140 | 121-LC-1.1 | VAPGQTARI | 19 | 11 | No | low |
| 141 | 121-LC-1.2 | VSPGETAKI | 15 | 6 | No | low |
| 142 | 121-LC-1.3 | VSPLSVALG | 25 | 17 | No | high |
| 143 | 121-LC-1.4 | LAPGATAKI | 13 | 11 | No | moderate |
| 144 | 121-LC-2 | LIIYNNQDR | 27 | 20 | No | high |
| 145 | 121-LC-2.1 | LIIYNNNDR | 28 | 22 | No | high |
| 146 | 121-LC-2.2 | LLIYNNQDR | 26 | 19 | No | high |
| 147 | 121-LC-3 | FGTTATLTI | 17 | 12 | No | moderate |
| 148 | 121-LC-3.1 | PGTTATLTI | 0 | 0 | No | low |
| 149 | 121-LC-3.2 | IGVTATLTI | 31 | 20 | No | high |
| 150 | 121-LC-4 | FGGGTTLTV | 17 | 12 | No | moderate |
| 151 | 121-LC-4.1 | FGEGTTLIV | 7 | 2 | No | low |
| 152 | 121-LC-4.2 | FDRGTTLTV | 7 | 2 | No | low |
| 153 | 121-LC-4.3 | FGGATRLTV | 15 | 14 | No | low |
| 154 | 121-LC-4.4 | FGGGTQLTV | 10 | 3 | No | low |
| 155 | 121-LC-4.5 | FAGGTGLTV | 6 | 2 | No | low |

TABLE 16

Ex vivo T-cell epitope mapping screen results for PGT-121 L06 HC and LC and variants designed to reduce immunogenicity.

| SEQ ID NO | Contains In-silico Epitopes (core 9-mer) | Epitope Sequence | % Donor Response (50 donors, except * 37 donors) | Mean Stimulation Index (>2 is positive) |
|---|---|---|---|---|
| 156 | 121-HC-2 | VSGASISDSYWSWIR | 30 | 2.34 |
| 157 | 121-HC-3 | SYWSWIRRSPGKGLE | 20 | 2.39 |
| 158 | 121-HC-6, 121-HC-7 | QVSLSLVAATAADSG | 54* | 3.65 |
| 159 | 121-HC-6.2, 121-HC-7.1 | QVSLSLTSVTAADSG | 30 | 4.03 |
| 160 | 121-HC-6.3, 121-HC-7.6 | QVSLSLSSVTAADSG | 2 | 2.31 |
| 161 | 121-HC-7.2 | QVSLSLTGVTAADSG | 4 | 2.18 |
| 162 | 121-HC-10 | IYGIVAFNEWFTYFY | 8 | 2.29 |
| 163 | 121-HC-11 | FNEWFTYFYMDVWGN | 12 | 2.05 |
| 164 | 121-HC-11.1 | FNEWFTYFYMDVWGK | 8 | 1.97 |
| 165 | 121-HC-11.4 | FNEWFTYFYMDVWGH | 22 | 2.28 |
| 166 | 121-HC-11.3 | FNEWFTYFYMDVWGA | 6 | 2.08 |
| 167 | 121-HC-11.6 | FNEWFTYFYMDVWGT | 20 | 2.17 |
| 168 | 121-HC-11 | WFTYFYMDVWGNGTQ | 34 | 2.45 |

TABLE 16-continued

Ex vivo T-cell epitope mapping screen results for PGT-121 L06 HC and LC and variants designed to reduce immunogenicity.

| SEQ ID NO | Contains In-silico Epitopes (core 9-mer) | Epitope Sequence | % Donor Response (50 donors, except * 37 donors) | Mean Stimulation Index (>2 is positive) |
|---|---|---|---|---|
| 169 | 121-HC-11.1 | WFTYFYMDVWGKGTQ | 22 | 2.27 |
| 170 | 121-HC-11.4 | WFTYFYMDVWGHGTQ | 8 | 2.48 |
| 171 | 121-HC-11.3 | WFTYFYMDVWGAGTQ | 0 | 0 |
| 172 | 121-HC-11.6 | WFTYFYMDVWGTGTQ | 2 | 2.82 |
| 173 | 121-HC-11 | YFYMDVWGNGTQVTV | 30 | 2.35 |
| 174 | 121-HC-11.1 | YFYMDVWGKGTQVTV | 38 | 3 |
| 175 | 121-HC-11.4 | YFYMDVWGHGTQVTV | 20 | 2.24 |
| 176 | 121-HC-11.3 | YFYMDVWGAGTQVTV | 4 | 2.27 |
| 177 | 121-HC-11.6 | YFYMDVWGTGTQVTV | 0 | 0 |
| 178 | 121-LC-3 | FGTTATLTITSVEAG | 18 | 2.18 |
| 179 | 121-LC-3 | SPFGTTATLTITSVE | 60 | 2.31 |
| 180 | 121-LC-3 | SPDSPFGTTATLTIT | 28 | 2.22 |
| 181 | 121-LC-4 | PTKWVFGGGTTLTVL | 18 | 2.43 |

To assess clinical immunogenicity risk of selected antibody variants, the ex vivo time course T-cell assay (EPISCREEN™, Antitope, Ltd., Cambridge, UK) was used to measure T-cell activation induced by intact antibodies. The whole molecule assay was conducted as described (Baker and Jones 2007. Curr. Opin. Drug Discov. Devel. 10: 219-227). Thus, this assay takes into account not just T-cell epitope content, but also the processing of the native IgG. Unlike the in silico and peptide scanning assays, the whole molecule ex vivo T-cell activation assay can provide an assessment of the relative clinical risk of a given antibody, and in certain cases may be used to predict clinical immunogenicity rates as described (Baker and Jones 2007Curr. Opin. Drug Discov. Devel. 10:219-227).

Figure 22:
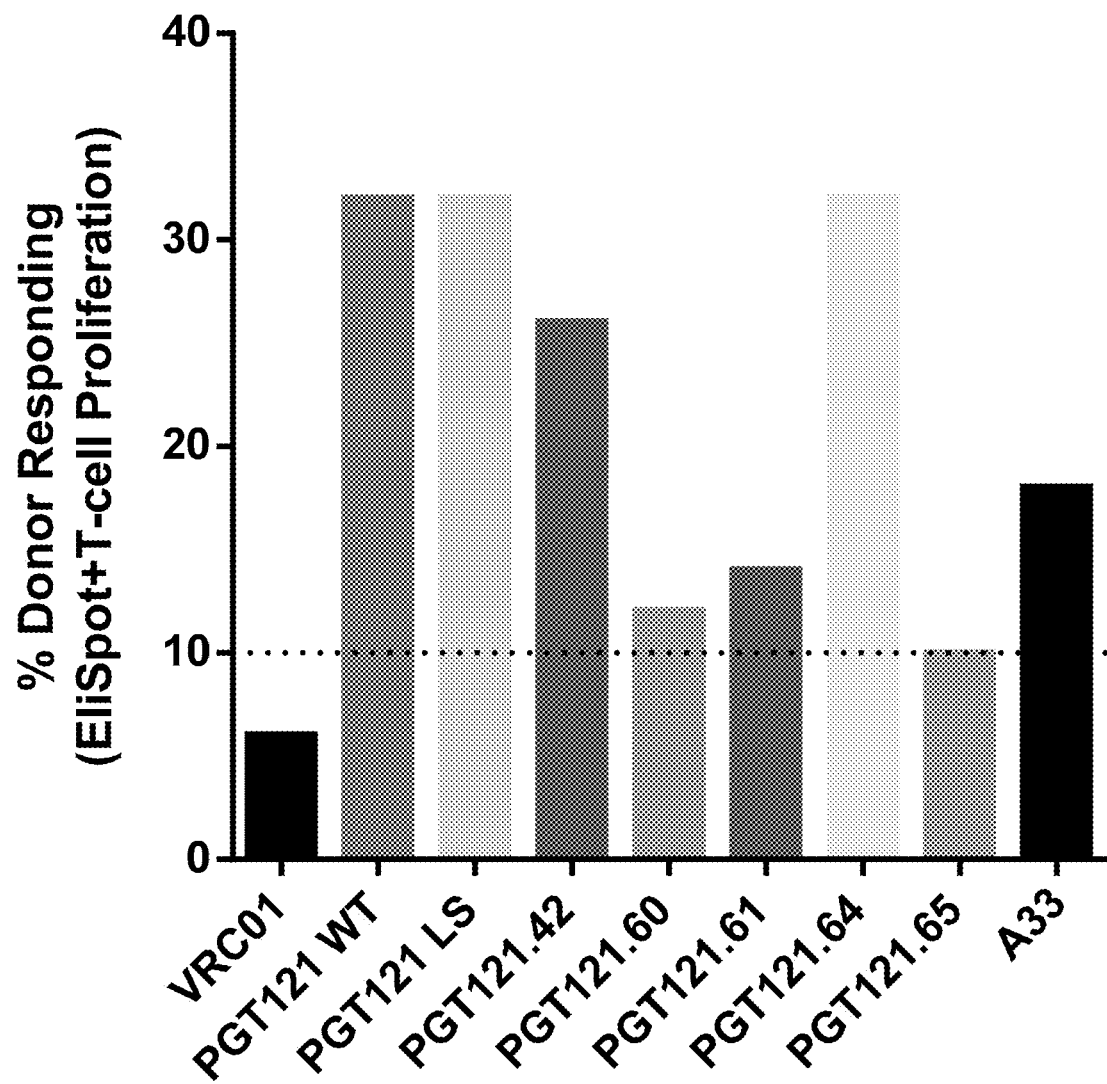

Many clinical stage antibodies have been run in this assay, and antibodies showing little to no clinical immunogenicity have scores near or below 10% (dotted line) in this assay while antibodies showing high clinical immunogenicity such as Alemtuzumab and Infliximab show scores in the 25-40% range (Baker and Jones 2007. Curr. Opin. Drug Discov. Devel. 10:219-227). PGT121.42, PGT121.60, PGT121.61 and PGT121.65 showed reduced donor response rates when compared to PGT121 WT, supporting a reduced risk of clinical immunogenicity for these variants (FIG. 22).

FcRn Binding

The neonatal Fc receptor (FcRn) is an Fc receptor that has been shown to play a major role in regulating the pharmacokinetic s of IgG molecules in human and preclinical species. Following endocytosis, at acidic pH (<6.5), FcRn binds to the Fc portion of IgG with high affinity. FcRn bound IgG is recycled back to the extracellular space, where at physiological pH IgG binding affinity is reduced and IgG is released back into the circulation. Free IgG that is not salvaged by the FcRn pathway is degraded in the lysosome to endogenous amino acids. The relative binding affinity characteristics of IgG to FcRn at pH 6.0/7.0 has become a well-established correlate for ranking the half-life of IgGs in vivo and a design feature for pharmacokinetic optimization.

The binding of antibodies to FcRn of various species at different pHs was determined. A 96-well Maxisorp plate was coated with 100 ul of 5 µg/ml FcRn. The plate was incubated overnight at 4° C., and then blocked with 4% skim milk for 2 hr at room temperature after washing 3 times with 0.05% Tween 20 washing buffer. The plate was incubated with 3 fold serial dilution of primary antibody for 1 hr at room temperature. The plate was then washed 3 times and 100 of Fab-anti-human Fab-HRP or Goat anti-human IgG-HRP secondary antibody diluted in 4% skimmed milk was added. Plates were then incubated 50 min at room temperature, washed three times, and 100 µL fresh TMB substrate was added. Plates were developed for 3 minutes on bench with gentle shaking. Plate was quenched with 100 µL 1M HCl, shaken briefly, read at A450 on a spectramax m5 plate reader.

Figure 23A:
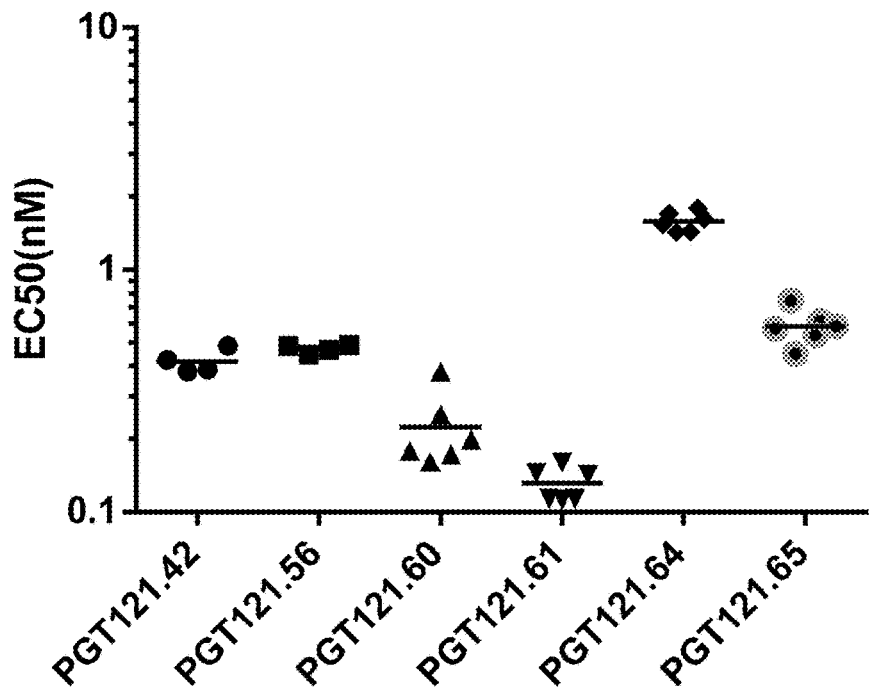
Figure 23B:
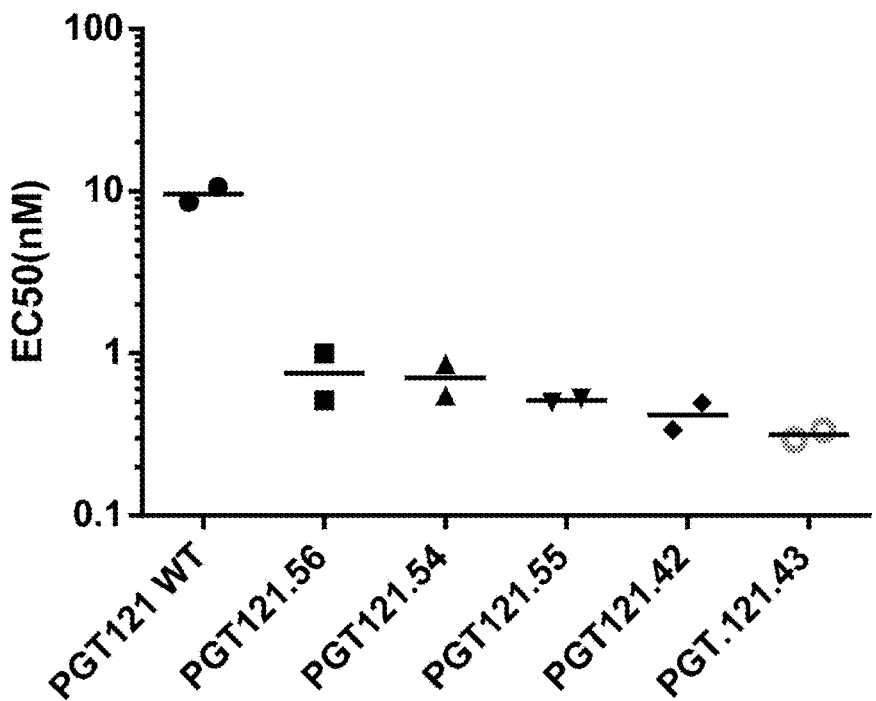

Relative to PGT-121, antibodies of the present invention comprising LS mutations in the Fc portion of IgG that interacts with FcRn showed a significant improvement in FcRn binding at pH 6.0 with lesser impact on binding at neutral pH of 7.0, as represented by the ratio of pH 7.0/6.0 for Human FcRn. The improved binding was attributed to the presence of the LS mutations and is predicted to provide for a prolonged half-life in humans relative to PGT-121. Data is shown in Table 17 and FIGS. 23A and 23B.

TABLE 17

Human FcRn binding data for PGT121 and variants

| PGT121 Variants | pH 6.0 $EC_{50}$ (nM) | pH 7.0 $EC_{50}$ (nM) | Ratio pH 7.0/6.0 | Fold vs PGT121 |
|---|---|---|---|---|
| PGT121 | 10.9 | 358 | 33 | 1 |
| 121.42 | 0.41 | 69.8 | 170 | 5 |

TABLE 17-continued

Human FcRn binding data for PGT121 and variants

| PGT121 Variants | pH 6.0 EC$_{50}$ (nM) | pH 7.0 EC$_{50}$ (nM) | Ratio pH 7.0/6.0 | Fold vs PGT121 |
|---|---|---|---|---|
| 121.56 | 0.47 | 102.2 | 217 | 7 |
| 121.60 | 0.22 | 78 | 355 | 11 |
| 121.61 | 0.13 | 139.5 | 1073 | 33 |
| 121.64 | 1.59 | 125.1 | 79 | 2 |
| 121.65 | 0.57 | 103.6 | 182 | 6 |

This data shows significant improvement of PGT121.60 and 61 over PGT121.56 or PGT121.42. PGT121.56 is the WT Fab with DEAL+LS Fc. This suggests that the Fab mutations in PGT121.60 and 61 improve FcRn binding. PGT121.64 and PGT121.65 do not show this improvement, suggesting that the Fab modifications in these two variants may actually reduce FcRn binding.

In Vivo Profiling

Figure 24:
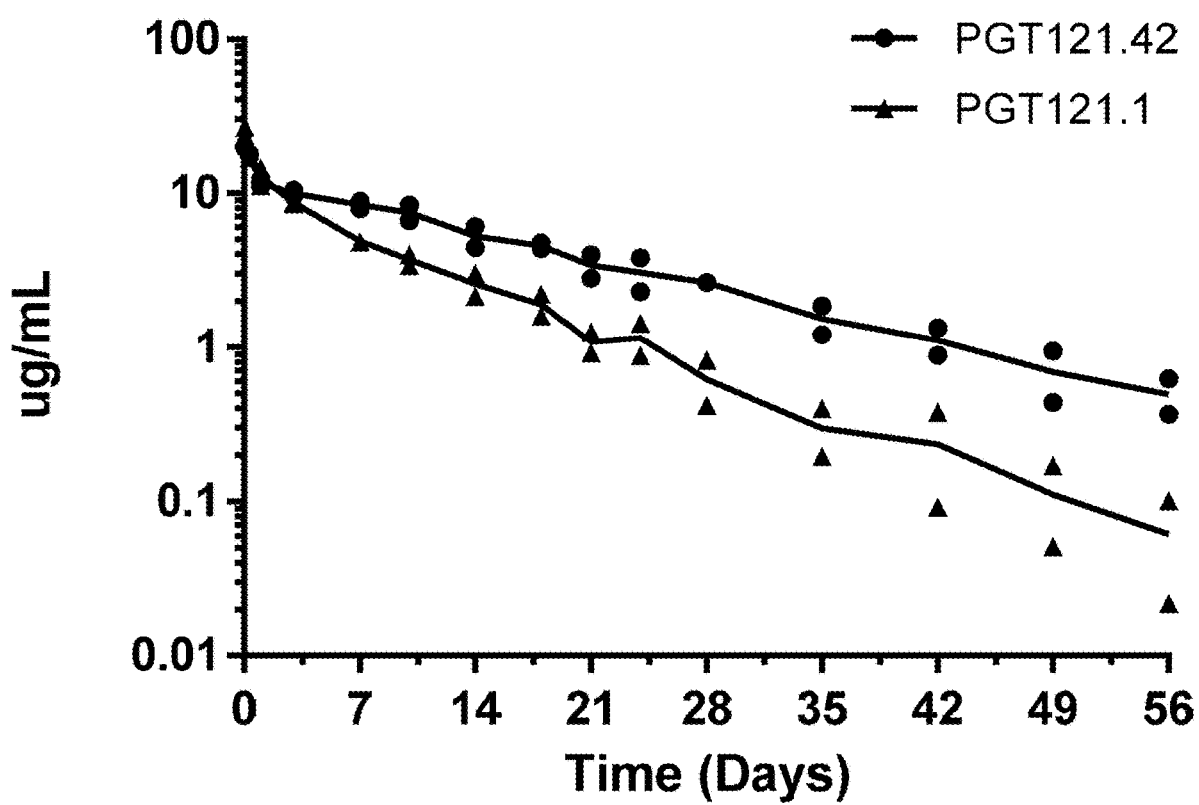
FIG. 24 is a graph showing serum concentration-time profiles for PGT121.1 (triangle) and PGT121.42 (circle) following 1 mg/kg IV bolus dosing to Naïve cynomolgus monkeys (n=2). Each symbol is the measured concentration from each individual animal and the line represents mean of two subjects.

PGT121 and several antibodies from the present application were assayed to characterize their basic pharmacokinetic profiles to ensure that the Fab/Fc modifications present in the antibodies of the present invention enhanced, and did not significantly perturb, the PGT121 intrinsic pharmacokinetic behavior. The in vivo disposition of PGT121 and several other antibodies of invention were characterized after a single intravenous (IV) 1.0 mg/kg dose in two male naïve cynomolgus monkeys (n=2). Serum samples were collected from monkeys and analyzed using a bioanalytical method (described herein) to determine serum concentration-time profiles and mean serum pharmacokinetic parameters by non-compartmental pharmacokinetic analysis (NCA). The pharmacokinetic concentration-time profiles for PGT121 compared to PGT121.42, an illustrative antibody of the invention, are depicted in FIG. 24.

Figure 25:
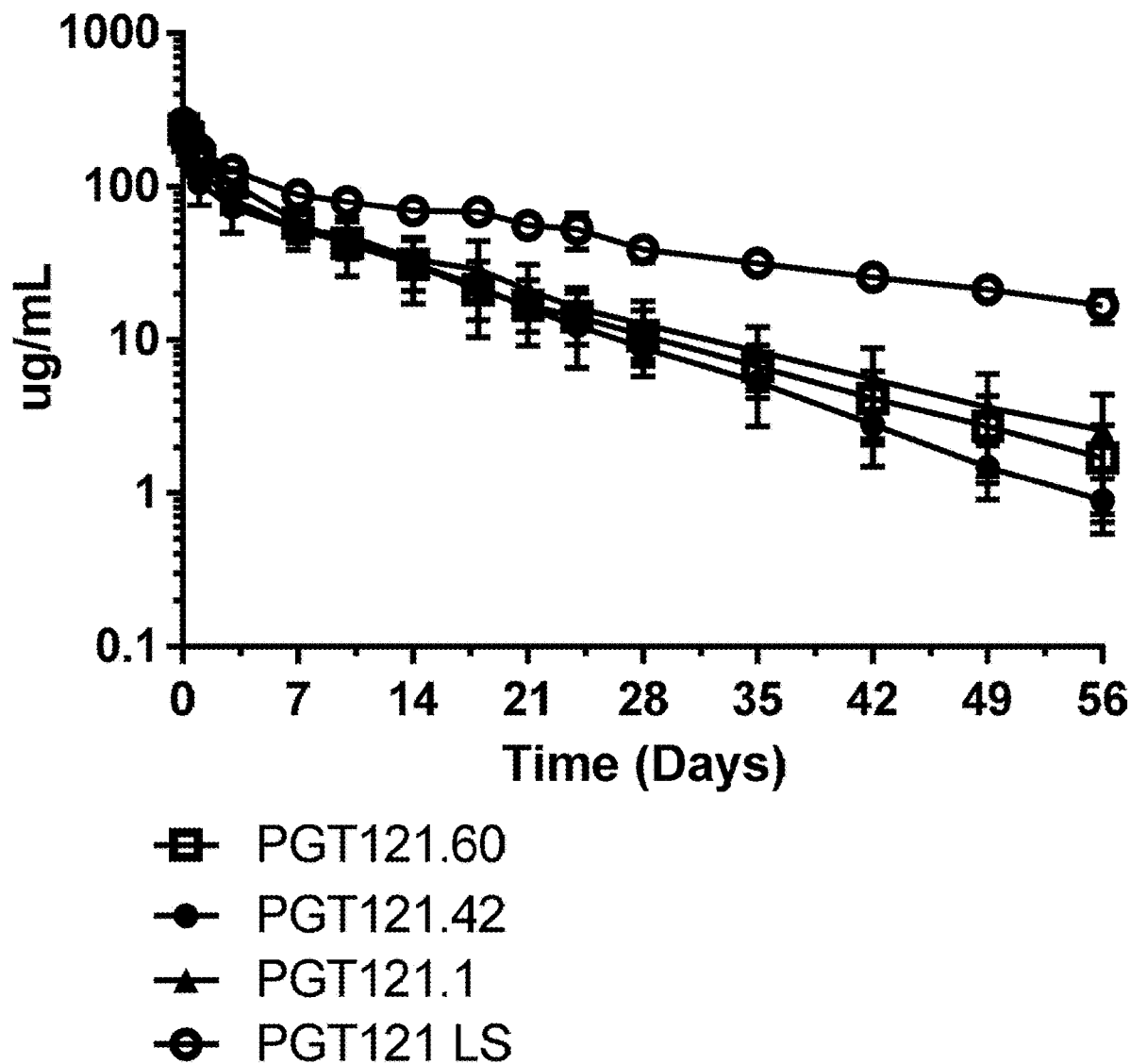
FIG. 25 is a graph showing serum concentration-time profiles for PGT121.1 (triangle), PGT121.42 (circle), PGT121 LS (open circle), and PGT121.60 (open square) following 10 mg/kg IV dosing to naïve cynomolgus monkeys (n=3). Each symbol is the measured concentration from each individual animal and the line represents mean of three subjects.

In a separate study, the intrinsic pharmacokinetic behavior of PGT121, PGT121 LS, and new lots of PGT121.42 and PGT121.60 were characterized after a single IV 10.0 mg/kg dose in three male naïve cynomolgus monkeys (n=3). Serum samples were collected and analyzed using a bioanalytical method (described herein) to determine serum concentration-time profiles and mean serum pharmacokinetic parameters by non-compartmental pharmacokinetic analysis (NCA). The pharmacokinetic concentration-time profiles for a 10 mg/kg IV dose of PGT121, PGT121 LS, PGT121.42 and PGT121.60 are depicted in FIG. 25.

The mean serum pharmacokinetic parameters of PGT121, PGT121.42, PGT121.43, PGT121.60, and PGT121.61 were determined from the non-compartmental pharmacokinetic analysis of the concentration-time profiles and are depicted in Table 18. All antibodies of the invention that were tested in vivo had comparable or improved pharmacokinetics (as defined herein) relative to PGT121.

TABLE 18

Pharmacokinetic parameters of PGT121 and variants after IV administration (1 mg/kg) in naïve cynomolgus monkeys (n = 2)

| mAb Variant | AUC$_{0-\infty}$ (day*ug/mL) | Cl (mL/day/kg) | V$_d$ (mL/kg) | t$_{1/2}$ (day) |
|---|---|---|---|---|
| PGT121 | 120 | 8.38 | 89.9 | 7.5 |
| PGT121.42 | 217 | 4.63 | 77.9 | 11.8 |
| PGT121.43 | 191 | 5.25 | 70.0 | 9.1 |

TABLE 18-continued

Pharmacokinetic parameters of PGT121 and variants after IV administration (1 mg/kg) in naïve cynomolgus monkeys (n = 2)

| mAb Variant | AUC$_{0-\infty}$ (day*ug/mL) | Cl (mL/day/kg) | V$_d$ (mL/kg) | t$_{1/2}$ (day) |
|---|---|---|---|---|
| PGT121.60 | 127 | 7.95 | 113 | 9.9 |
| PGT121.61 | 117 | 8.76 | 127 | 10.5 |

The mean serum pharmacokinetic parameters of PGT121, PGT121 LS, PGT121.42, and PGT121.60 were determined from the non-compartmental pharmacokinetic analysis of the concentration-time profiles and are depicted in Table 19. All antibodies of the invention that were tested in vivo had comparable or improved pharmacokinetics (as defined herein) relative to PGT121. Results of additional characterizations were shown in Tables 20-27. Table 23 indicates that PGT121.60 showed increased potency against the tested viruses, compared to PGT121. Table 24 shows that some the PGT121 variants such as PGT121.60, PGT121.64 and PGT121.65 exhibited improved potency across all viral isolates tested (also see FIG. 20). This suggests that the modifications made (likely the modifications made to the antigen contact residues outside the CDRs) improved neutralization potency. Table 25 illustrates that PGT121.60 showed about increased naturalizing activities against the viruses representing B and non-B subtypes, compared to PGT121.

TABLE 19

Pharmacokinetic parameters of PGT121, PGT121 LS, PGT121.42, and PGT121.60 after IV administration (10 mg/kg) in naïve cynomolgus monkeys (n = 3)

| Test Article | AUC$_{0-\infty}$ (day*µg/mL) | Cl (mL/day/kg) | V$_d$ (mL/kg) | t$_{1/2}$ (day) |
|---|---|---|---|---|
| PGT121 | 1510 | 7.0 | 111 | 11.4 |
| PGT121 LS | 3670 | 2.8 | 95.1 | 24.3 |
| PGT121.42 | 1240 | 8.2 | 97.9 | 8.2 |
| PGT121.60 | 1490 | 7.0 | 96.4 | 9.7 |

TABLE 20

Primary NK cell-mediated ADCC activity of a select set of PGT121 variants against primary CD4$^+$ T cells infected with 2 HIV-1 strains, US657 or HT539

| Donor A4813 | Emax (%) | | EC$_{50}$ (nM) | | AUC | |
|---|---|---|---|---|---|---|
| mAb Variant | US657 | HT593 | US657 | HT593 | US657 | HT593 |
| PGT121.56 | 71 | 72 | 1.5 | 6.3 | 219 | 161 |
| PGT121.42 | 72 | 71 | 1.4 | 4.9 | 222 | 191 |
| PGT121.60 | 72 | 67 | 1.2 | 0.7 | 220 | 185 |
| PGT121.61 | 72 | 70 | 1.3 | 2.2 | 190 | 169 |
| PGT121.64 | 70 | 66 | 1.6 | 1.4 | 188 | 167 |
| PGT121.65 | 75 | 71 | 3.2 | 2.6 | 190 | 158 |

TABLE 21

Primary NK cell-mediated ADCC activity of PGT121 and PGT121.60, against CEM.NKr.CCR5.Luc cells infected with 3 HIV-1 isolates

| mAb Variant | NK Donor | US727 Emax (%) | US727 EC$_{50}$ (nM) | US727 AUC | HT593 Emax (%) | HT593 EC$_{50}$ (nM) | HT593 AUC | US657 Emax (%) | US657 EC$_{50}$ (nM) | US657 AUC |
|---|---|---|---|---|---|---|---|---|---|---|
| PGT121 | A5277 | 23 | 7.1 | 45 | 7 | 2.4 | 35 | nd | nd | 3 |
|  | A5278 | 31 | 1.1 | 106 | 6 | 4.9 | 16 | nd | nd | 2 |
| PGT121.60 | A5277 | 60 | 0.5 | 195 | 62 | 1.1 | 178 | 67 | 6.9 | 153 |
|  | A5278 | 58 | 0.2 | 212 | 59 | 1.0 | 189 | 58 | 3.5 | 139 |
| PGT121.60 | A5277 | 60 | 0.9 | 174 | 57 | 2.3 | 147 | 63 | 5.8 | 147 |
|  | A5278 | 60 | 0.5 | 189 | 61 | 2.1 | 157 | 66 | 10.9 | 128 |

TABLE 22

Neutralization activity (IC$_{50}$) of PGT121 and PGT121.60 against subtype B viruses

| Isolate | Tropism | PGT121 IC50 (µg/mL) | PGT121.60 IC50 (µg/mL) | PGT121 IC50/ PGT121.60 IC50 |
|---|---|---|---|---|
| MGRM-B-106 | DM | 0.0041 | 0.0010 | 4.1 |
| MGRM-B-112 | DM | 0.0145 | 0.0058 | 2.5 |
| MGRM-B-136 | X4 | 0.0087 | 0.0071 | 1.2 |
| MGRM-B-105 | DM | 0.0219 | 0.0076 | 2.9 |
| MGRM-B-132 | X4 | 0.0092 | 0.0077 | 1.2 |
| MGRM-B-110 | DM | 0.0373 | 0.0113 | 3.3 |
| MGRM-B-115 | DM | 0.2362 | 0.1412 | 1.7 |
| MGRM-B-111 | DM | 2.1336 | 0.9549 | 2.2 |
| MGRM-B-118 | DM | 2.4658 | 3.3142 | 0.7 |

TABLE 23

Neutralization potency of PGT121 and PGT121.60 against subtype B viruses

| Virus ID | PGT121 IC50 (µg/mL) | PGT121.60 IC50 (µg/mL) | PGT121 IC50/PGT121.60 IC50 |
|---|---|---|---|
| 15-124986 | 0.0048 | 0.0015 | 3.2 |
| 15-124918 | 0.0054 | 0.0018 | 3.0 |
| 15-124914 | 0.0059 | 0.0020 | 3.0 |
| 15-124964 | 0.0092 | 0.0026 | 3.5 |
| 15-124906 | 0.0550 | 0.0103 | 5.3 |
| 15-124904 | 0.0375 | 0.0121 | 3.1 |
| 15-102514 | 0.0450 | 0.0128 | 3.5 |
| 15-101757 | 0.0621 | 0.0132 | 4.7 |
| 15-124987 | 0.0510 | 0.0163 | 3.1 |
| 15-124962 | 0.0955 | 0.0277 | 3.4 |
| 15-124970 | 0.1101 | 0.0285 | 3.9 |
| 15-124950 | 0.2996 | 0.0995 | 3.0 |
| 15-124975 | 0.5775 | 0.1052 | 5.5 |
| 15-124934 | 9.6415 | 0.7973 | 12.1 |
| 15-101608 | 6.7016 | 1.8392 | 3.6 |
| 15-124963 | 16.8855 | 2.0546 | 8.2 |

TABLE 24

Neutralization potency and coverage of PGT121 and select variants against 92 subtype B viruses

| mAb | Median IC95 (µg/mL) | PGT121 IC50/Variant IC50 | Coverage (%) |
|---|---|---|---|
| PGT121 | 0.329 | 1.0 | 57.6 |
| PGT121.13 | 0.629 | 0.5 | 51.1 |
| PGT121.42 | 0.277 | 1.2 | 63.0 |
| PGT121.43 | 0.266 | 1.2 | 62.0 |
| PGT121.54 | 0.283 | 1.2 | 63.0 |
| PGT121.55 | 0.275 | 1.2 | 63.0 |
| PGT121.56 | 0.265 | 1.2 | 62.0 |
| PGT121.58 | 0.244 | 1.3 | 58.7 |
| PGT121.59 | 0.253 | 1.3 | 60.9 |
| PGT121.60 | 0.177 | 1.9 | 59.8 |
| PGT121.61 | 0.327 | 1.0 | 58.7 |
| PGT121.62 | 0.254 | 1.3 | 63.0 |
| PGT121.63 | 0.379 | 0.9 | 60.9 |
| PGT121.64 | 0.129 | 2.6 | 59.8 |
| PGT121.65 | 0.165 | 2.0 | 59.8 |

TABLE 25

Neutralization activity of PGT121 and PGT121.60 against multiclade viruses

| Virus ID | PGT121 IC50 (µg/mL) | PGT121.60 IC50 (µg/mL) | PGT121 IC50/ PGT121.60 IC50 |
|---|---|---|---|
| MGRM-Chronic-B-004 | 0.0078 | 0.0013 | 6.0 |
| MGRM-Acute-B-005 | 0.0043 | 0.0014 | 3.1 |
| MGRM-Acute-B-009 | 0.0037 | 0.0016 | 2.3 |
| MGRM-Chronic-B-020 | 0.0038 | 0.0018 | 2.1 |
| MGRM-Chronic-B-006 | 0.0056 | 0.0020 | 2.8 |
| MGRM-Chronic-B-023 | 0.0043 | 0.0034 | 1.3 |
| MGRM-Chronic-B-008 | 0.0111 | 0.0056 | 2.0 |
| MGRM-Chronic-B-010 | 0.0154 | 0.0074 | 2.1 |
| MGRM-Chronic-B-003 | 0.0080 | 0.0079 | 1.0 |
| MGRM-Chronic-B-009 | 0.0224 | 0.0112 | 2.0 |
| MGRM-Acute-B-003 | 0.0361 | 0.0179 | 2.0 |
| MGRM-Acute-B-007 | 0.0466 | 0.0255 | 1.8 |
| MGRM-Chronic-B-016 | 0.0583 | 0.0283 | 2.1 |
| MGRM-Acute-B-001 | 0.0739 | 0.0313 | 2.4 |
| MGRM-Acute-B-010 | 0.0466 | 0.0328 | 1.4 |
| MGRM-Chronic-B-012 | 0.0914 | 0.0409 | 2.2 |
| MGRM-Acute-B-004 | 0.0933 | 0.0497 | 1.9 |
| MGRM-Chronic-B-002 | 0.1010 | 0.0649 | 1.6 |
| MGRM-Chronic-B-005 | 0.0866 | 0.0720 | 1.2 |
| MGRM-Acute-B-006 | 0.1307 | 0.0966 | 1.4 |
| MGRM-Chronic-B-001 | 0.1257 | 0.0985 | 1.3 |
| MGRM-Chronic-B-014 | 0.2879 | 0.1334 | 2.2 |
| MGRM-Chronic-B-015 | 0.2736 | 0.1855 | 1.5 |
| MGRM-Chronic-B-019 | 0.3462 | 0.1993 | 1.7 |
| MGRM-Chronic-B-007 | 2.1241 | 2.5544 | 0.8 |
| MGRM-Chronic-B-022 | >50 | 11.4677 |  |
| MGRM-C-026 | 0.0016 | 0.0004 | 4.0 |
| MGRM-C-011 | 0.0028 | 0.0012 | 2.3 |
| MGRM-C-006 | 0.0091 | 0.0030 | 3.0 |
| MGRM-C-027 | 0.0054 | 0.0038 | 1.4 |
| MGRM-C-022 | 0.0101 | 0.0038 | 2.7 |
| MGRM-C-023 | 0.0179 | 0.0044 | 4.1 |

TABLE 25-continued

Neutralization activity of PGT121 and PGT121.60 against multiclade viruses

| Virus ID | PGT121 IC50 (μg/mL) | PGT121.60 IC50 (μg/mL) | PGT121 IC50/ PGT121.60 IC50 |
|---|---|---|---|
| MGRM-C-008 | 0.0075 | 0.0044 | 1.7 |
| MGRM-C-017 | 0.0087 | 0.0058 | 1.5 |
| MGRM-C-004 | 0.0118 | 0.0064 | 1.8 |
| MGRM-C-005 | 0.0145 | 0.0078 | 1.9 |
| MGRM-C-002 | 0.0219 | 0.0095 | 2.3 |
| MGRM-C-016 | 0.0083 | 0.0137 | 0.6 |
| MGRM-C-012 | 0.1060 | 0.0338 | 3.1 |
| MGRM-C-024 | 0.1703 | 0.0826 | 2.1 |
| MGRM-C-007 | 0.2868 | 0.1993 | 1.4 |
| MGRM-C-028 | 1.3581 | 0.7440 | 1.8 |
| MGRM-C-018 | 28.1619 | 10.3254 | 2.7 |
| MGRM-C-013 | 36.4162 | 12.2616 | 3.0 |
| MGRM-C-020 | >50 | 14.8835 | |
| MGRM-A-014 | 0.0032 | 0.0010 | 3.2 |
| MGRM-A-002 | 0.0199 | 0.0047 | 4.2 |
| MGRM-A-009 | 0.0072 | 0.0074 | 1.0 |
| MGRM-A-012 | 0.1364 | 0.0397 | 3.4 |
| MGRM-A-013 | 0.6126 | 0.0561 | 10.9 |
| MGRM-A-003 | 0.2001 | 0.0865 | 2.3 |
| MGRM-A-010 | 1.1108 | 0.7452 | 1.5 |
| MGRM-A-006 | 1.0250 | 4.0544 | 0.3 |
| MGRM-AG-006 | 0.0242 | 0.0106 | 2.3 |
| MGRM-AG-009 | 0.1000 | 0.0868 | 1.2 |
| MGRM-AG-007 | 0.1649 | 0.1082 | 1.5 |
| MGRM-AG-005 | 1.5876 | 0.2029 | 7.8 |
| MGRM-AG-001 | 4.6658 | 1.4409 | 3.2 |
| MGRM-AG-008 | 1.7322 | 1.7064 | 1.0 |
| MGRM-D-002 | 0.0049 | 0.0015 | 3.3 |
| MGRM-D-014 | 0.0068 | 0.0019 | 3.6 |
| MGRM-D-011 | 0.0122 | 0.0043 | 2.8 |
| MGRM-D-001 | 0.7988 | 0.4310 | 1.9 |
| MGRM-F1-010 | 0.0092 | 0.0125 | 0.7 |
| MGRM-F1-018 | 0.0244 | 0.0201 | 1.2 |
| MGRM-F1-020 | 0.0603 | 0.0410 | 1.5 |
| MGRM-F1-014 | 0.0551 | 0.0509 | 1.1 |
| MGRM-F1-013 | 0.0547 | 0.0871 | 0.6 |
| MGRM-F1-016 | 0.9707 | 0.5219 | 1.9 |
| MGRM-F1-004 | 4.7363 | 0.5474 | 8.7 |
| MGRM-F1-012 | 2.3340 | 1.1877 | 2.0 |
| MGRM-F1-006 | 8.8384 | 2.3278 | 3.8 |
| MGRM-F1-015 | 32.6175 | 11.5867 | 2.8 |
| MGRM-G-014 | 0.0035 | 0.0034 | 1.0 |
| MGRM-G-001 | 0.0022 | 0.0050 | 0.4 |
| MGRM-G-019 | 0.0079 | 0.0091 | 0.9 |
| MGRM-G-024 | 0.0240 | 0.0119 | 2.0 |
| MGRM-G-017 | 0.0258 | 0.0255 | 1.0 |
| MGRM-G-004 | 0.3741 | 0.0460 | 8.1 |
| MGRM-G-013 | 1.8198 | 1.4978 | 1.2 |
| MGRM-G-011 | 2.1778 | 1.9067 | 1.1 |

TABLE 26

Killing of HIV-infected primary CD4 T cells against 6 HIV-1 strains

| Donor | Virus | EC$_{50}$ (μg/mL) | | Emax (%) | |
|---|---|---|---|---|---|
| | | PGT121 | PGT121.60 | PGT121 | PGT121.60 |
| 9089 | 7552 | 0.263 | 0.002 | 54 | 73 |
| | CH058 | 3.956 | 0.006 | 72 | 84 |
| | 92US712 | 0.307 | 0.008 | 47 | 70 |
| | 8176 | 0.567 | 0.023 | 44 | 64 |
| | 93HT593 | 0.871 | 0.119 | 46 | 68 |
| | 8320 | nc | 11.26 | 3 | 64 |
| 9090 | 7552 | 0.227 | 0.002 | 57 | 76 |
| | CH058 | 2.080 | 0.025 | 48 | 79 |
| | 92US712 | 0.368 | 0.026 | 53 | 77 |
| | 8176 | 1.0 | 0.062 | 47 | 72 |
| | 93HT593 | 0.998 | 0.637 | 40 | 67 |
| | 8320 | nc | 61.4 | 7 | 64 | nc: not calculable

TABLE 27

Killing of HIV-infected primary CD4 T cells against HIV-1 strain 92US657

| | EC50 (μg/mL) | | Emax (%) | |
|---|---|---|---|---|
| Donor | PGT121 | PGT121.60 | PGT121 | PGT121.60 |
| 4737 | 2.53 | 0.12 | 22 | 50 |
| 4736 | 50.9 | 1.0 | 10 | 52 |
| 4739 | >100 | 0.45 | 0 | 51 |

All of the above U.S. patents, U.S. patent application publications, U.S. patent applications, foreign patents, foreign patent applications and non-patent publications referred to in this specification and/or listed in the Application Data Sheet, are incorporated herein by reference, in their entirety.

The present invention may be embodied in other specific forms without departing from its structures, methods, or other essential characteristics as broadly described herein and claimed hereinafter. The described embodiments are to be considered in all respects only as illustrative, and not restrictive. The scope of the invention is, therefore, indicated by the appended claims, rather than by the foregoing description. All changes that come within the meaning and range of equivalency of the claims are to be embraced within their scope.

TABLE 1

| Clone Designation | PGT121 L06 |
|---|---|
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 190) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |

TABLE 1-continued

| | |
|---|---|
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 276) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121 hG1 (EFTEA)/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPSVFLFPPKPKDTLMISRTPEVTCVVVDVEFEDPEVKFN WYVDGVEVHNAKTKPREEQYNSTYRVVSVLTVLHQDWLNGKEYKCKVTNKALPAPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 191) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |

TABLE 1-continued

| | |
|---|---|
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 277) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121 hG1 (DEA)/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGAPDVFLFPPKPKDTLMISRTPEVTCVVVDVSHEDPEVKFN WYVDGVEVHNAKTKPREEQYNSTYRVVSVLTVLHQDWLNGKEYKCKVSNKALPAPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 192) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 278) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |

TABLE 1-continued

| | |
|---|---|
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121 hG1 (DEL)/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 193) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 279) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |

TABLE 1-continued

| | |
|---|---|
| Light CDR2 Honegger | NNQDRPSGIPER (SEQ ID NO: 403) |
| Light CDR3 Honegger | WDSRVPTKW (SEQ ID NO: 401) |
| Clone Designation | PGT121-FES/hLambda |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPEFEGGPSVFLFPPKPKDTLMISRTPEVTCVVVDVSHEDPEVKF<br>NWYVDGVEVHNAKTKPREEQYNSTYRVVSVLTVLHQDWLNGKEYKCKVSNKALPASI<br>EKTISKAKGQPREPQVYTLPPSREEMTKNQVSLTCLVKGFYPSDIAVEWESNGQPENN<br>YKTTPPVLDSDGSFFLYSKLTVDKSRWQQGNVFSCSVMHEALHNHYTQKSLSLSPGK<br>(SEQ ID NO: 194) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 280) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121-FEAQS hG1 |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPEFEGGPSVFLFPPKPKDTLMISRTPEVTCVVVAVSHEDPEVKFN<br>WYVDGVEVHNAKTKPREEQYQSTYRVVSVLTVLHQDWLNGKEYKCKVSNKALPASIE |

TABLE 1-continued

|   |   |
|---|---|
|   | KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 195) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 281) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121-DEAR hG1 |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLAGPDVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPEE<br>KTISKAKGQPRRPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 196) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |

TABLE 1-continued

| | |
|---|---|
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 282) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121-LPLIL hG1 |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLLPPKPKDTLMISRTPEVTCVVVDVSHEDPEVKFN WYVDGVEVHNAKTKPPEEQYNSTLRVVSILTVLHQDWLNGKEYKCKVSNKALPAPIEK TISKAKGQPREPQVYTLPPSREEMTKNQVSLTCLVKGFYPSDIAVEWESNGQPENNYK TTPLVLDSDGSFFLYSKLTVDKSRWQQGNVFSCSVMHEALHNHYTQKSLSLSPGK (SEQ ID NO: 197) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |

TABLE 1-continued

| | |
|---|---|
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 283) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121-FTEA hG1 |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLAGPSVFLFPPKPKDTLMISRTPEVTCVVVDVSFEDPEVKFN<br>WYVDGVEVHNAKTKPREEQYNSTYRVVSVLTVLHQDWLNGKEYKCKVTNKALPAPEE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 198) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 284) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |

TABLE 1-continued

| | |
|---|---|
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121-FTDE hG1 |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPDVFLFPPKPKDTLMISRTPEVTCVVVDVSFEDPEVKFN WYVDGVEVHNAKTKPREEQYNSTYRVVSVLTVLHQDWLNGKEYKCKVTNKALPAPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 199) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 285) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |

TABLE 1-continued

| Clone Designation | PGT121-AAA hG1 |
|---|---|
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVSHEDPEVKFN<br>WYVDGVEVHNAKTKPREEQYNATYRVVSVLTVLHQDWLNGKEYKCKVSNKALPAPIA<br>ATISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 200) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 286) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121 hIgG1 (VLPLL)/hLambda |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELVGGPSVFLLPPKPKDTLMISRTPEVTCVVVDVSHEDPEVKFN<br>WYVDGVEVHNAKTKPPEEQYNSTLRVVSVLTVLHQDWLNGKEYKCKVSNKALPAPIEK<br>TISKAKGQPREPQVYTLPPSREEMTKNQVSLTCLVKGFYPSDIAVEWESNGQPENNYK<br>TTPLVLDSDGSFFLYSKLTVDKSRWQQGNVFSCSVMHEALHNHYTQKSLSLSPGK<br>(SEQ ID NO: 201) |
| Heavy CDR1 Kabat | DSYWS (SEQ ID NO: 362) |
| Heavy CDR2 Kabat | YVHKSGDTNYSPSLKS (SEQ ID NO: 364) |

TABLE 1-continued

| | |
|---|---|
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 287) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121 hIgG1 (DE)/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPAPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 202) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |

TABLE 1-continued

| | |
|---|---|
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 288) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121 hIgG1 (DEA2)/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPDVFLFPPKPKDTLMISRTPEVTCVVVDVSHEDPEVKFN WYVDGVEVHNAKTKPREEQYNATYRVVSVLTVLHQDWLNGKEYKCKVSNKALPAPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 203) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 289) |
| Light CDR1 Kabat | GEKSLGSRAVQ (SEQ ID NO: 395) |
| Light CDR2 Kabat | NNQDRPS (SEQ ID NO: 396) |

TABLE 1-continued

| | |
|---|---|
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121 hIgG1 (DEALS)/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPAPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 204) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 290) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |

TABLE 1-continued

| | |
|---|---|
| Light CDR2 Honegger | NNQDRPSGIPER (SEQ ID NO: 403) |
| Light CDR3 Honegger | WDSRVPTKW (SEQ ID NO: 401) |
| Clone Designation | PGT121 hIgG1 (LS)/hLambda |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPIE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVLHEALHSHYTQKSLSLSPGK<br>(SEQ ID NO: 205) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 291) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121 hIgG1 (DEA2G)/hLambda |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLGGPDVFLFPPKPKDTLMISRTPEVTCVVVDVSHEDPEVKFN<br>WYVDGVEVHNAKTKPREEQYNATYRVVSVLTVLHQDWLNGKEYKCKVSNKALPAPEE |

TABLE 1-continued

| | |
|---|---|
| | KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHGALHNHYTQKSLSLSPGK<br>(SEQ ID NO: 206) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 292) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121 hIgG1 (DEAG)/hLambda |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLAGPDVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPEE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHGALHNHYTQKSLSLSPGK<br>(SEQ ID NO: 207) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |

TABLE 1-continued

```
Heavy CDR1 Chothia    GASISDS (SEQ ID NO: 379)

Heavy CDR2 Chothia    KSG

Heavy CDR3 Chothia    LHGRRIYGIVAFNEWFTYFYMD (SEQ ID NO: 382)

Heavy CDR1 Honegger   VSGASISDSY (SEQ ID NO: 385)

Heavy CDR2 Honegger   VHKSGDTNYSPSLKSR (SEQ ID NO: 388)

Heavy CDR3 Honegger   TLHGRRIYGIVAFNEWFTYFYMD (SEQ ID NO: 391)

Light Chain           SDISVAPGETARISCGEKSLGSRAVQWYQHRAGQAPSLIIYNNQDRPSGIPERFSGSPD
                      SPFGTTATLTITSVEAGDEADYYCHIWDSRVPTKWVFGGGTTLTVLGQPKAAPSVTLFP
                      PSSEELQANKATLVCLISDFYPGAVTVAWKADSSPVKAGVETTTPSKQSNNKYAASSYL
                      SLTPEQWKSHRSYSCQVTHEGSTVEKTVAPTECS (SEQ ID NO: 293)

Light CDR1 Kabat      GEKSLGSRAVQ (SEQ ID NO: 395)

Light CDR2 Kabat      NNQDRPS (SEQ ID NO: 396)

Light CDR3 Kabat      HIWDSRVPTKWV (SEQ ID NO: 397)

Light CDR1 IMGT       SLGSRA (SEQ ID NO: 399)

Light CDR2 IMGT       NNQ

Light CDR3 IMGT       HIWDSRVPTKWV (SEQ ID NO: 397)

Light CDR1 Chothia    EKSLGSRA (SEQ ID NO: 400)

Light CDR2 Chothia    NNQ

Light CDR3 Chothia    WDSRVPTKW (SEQ ID NO: 401)

Light CDR1 Honegger   EKSLGSRA (SEQ ID NO: 400)

Light CDR2 Honegger   NNQDRPSGIPER (SEQ ID NO: 403)

Light CDR3 Honegger   WDSRVPTKW (SEQ ID NO: 401)
```

| Clone Designation | PGT121 hIgG1 (DEG)/hLambda |
|---|---|
| Heavy Chain | QMQLQESGPGLVKPSETLSLTCSVSGASISDSYWSWIRRSPGKGLEWIGYVHKSGDT NYSPSLKSRVNLSDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPAPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHGALHNHYTQKSLSLSPGK (SEQ ID NO: 208) |

```
Heavy CDR1 Kabat      DSYWS (SEQ ID NO: 362)

Heavy CDR2 Kabat      YVHKSGDTNYSPSLKS (SEQ ID NO: 364)

Heavy CDR3 Kabat      TLHGRRIYGIVAFNEWFTYFYMDV (SEQ ID NO: 367)

Heavy CDR1 IMGT       GASISDSY (SEQ ID NO: 371)

Heavy CDR2 IMGT       VHKSGDT (SEQ ID NO: 374)

Heavy CDR3 IMGT       ARTLHGRRIYGIVAFNEWFTYFYMDV (SEQ ID NO: 375)

Heavy CDR1 Chothia    GASISDS (SEQ ID NO: 379)

Heavy CDR2 Chothia    KSG

Heavy CDR3 Chothia    LHGRRIYGIVAFNEWFTYFYMD (SEQ ID NO: 382)

Heavy CDR1 Honegger   VSGASISDSY (SEQ ID NO: 385)

Heavy CDR2 Honegger   VHKSGDTNYSPSLKSR (SEQ ID NO: 388)

Heavy CDR3 Honegger   TLHGRRIYGIVAFNEWFTYFYMD (SEQ ID NO: 391)
```

TABLE 1-continued

| | |
|---|---|
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 294) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121 hIgG1 (DEAL)/hLambda |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLAGPDVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPLPEE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 209) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 295) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |

TABLE 1-continued

| | |
|---|---|
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121 hIgG1 (AE)/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 210) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 296) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |

TABLE 1-continued

| | |
|---|---|
| Clone Designation | PGT121.23 hIgG1/hLambda |
| Heavy Chain | QMQLQESGPGLVKPSETLSLTCSVSGASISDSYWSWIRRSPGKGLEWIGYVHKSGDT<br>NYNPSLKSRVTLSLDTSKNQVSLSLVAATAADSGKYYCARTLHGRRIYGIVAFNEWFTY<br>FYMDVWGKGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPIE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 211) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SYVLTQPSDISVAPGETARISCGEKSLGSRAVQWYQHRAGQAPSLIIYNNQDRPSGIPE<br>RFSGSPDSPFGTTATLTITSVEAGDEADYYCHIWDSRVPTKWVFGGGTTLTVLGQPKA<br>APSVTLFPPSSEELQANKATLVCLISDFYPGAVTVAWKADSSPVKAGVETTTPSKQSNN<br>KYAASSYLSLTPEQWKSHRSYSCQVTHEGSTVEKTVAPTECS (SEQ ID NO: 297) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.22 hIgG1/hLambda |
| Heavy Chain | QMQLQESGPGLVKPSETLSLTCSVSGASISDAYWSWIRRSPGKGLEWIGYVHKSGDT<br>NYNPSLKSRVTLSLDTSKNQVSLSLVAATAADSGKYYCARTLHGRRIYGIVAFNEWFTY<br>FYMDVWGKGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPIE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 212) |
| Heavy CDR1 Kabat | DAYWS (SEQ ID NO: 363) |
| Heavy CDR2 Kabat | YVHKSGDTNYNPSLKS (SEQ ID NO: 366) |

TABLE 1-continued

| | |
|---|---|
| Heavy CDR3 Kabat | TLHGRRIYGIVAFNEWFTYFYMDV (SEQ ID NO: 367) |
| Heavy CDR1 IMGT | GASISDAY (SEQ ID NO: 372) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDA (SEQ ID NO: 380) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDAY (SEQ ID NO: 386) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 298) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.21 hIgG1/hLambda |
| Heavy Chain | QMQLQESGPGLVKPSETLSLTCSVSGASISDSYWSWIRRSPGKGLEWIGYVHKSGDT NYNPSLKSRVTLSLDTSKNQVSLSLVAATAADSGKYYCARTLHGRRIYGIVAFNEWFTY FYMDVWGKGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 213) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |

TABLE 1-continued

| | |
|---|---|
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 299) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.20 hIgG1/hLambda |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPIE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 214) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTNWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 300) |
| Light CDR1 Kabat | GEKSLGSRAVQ (SEQ ID NO: 395) |
| Light CDR2 Kabat | NNQDRPS (SEQ ID NO: 396) |

TABLE 1-continued

| | |
|---|---|
| Light CDR3 Kabat | HIWDSRVPTNWV (SEQ ID NO: 398) |
| Light CDR1 IMGT | SLGSRA (SEQ ID NO: 399) |
| Light CDR2 IMGT | NNQ |
| Light CDR3 IMGT | HIWDSRVPTNWV (SEQ ID NO: 398) |
| Light CDR1 Chothia | EKSLGSRA (SEQ ID NO: 400) |
| Light CDR2 Chothia | NNQ |
| Light CDR3 Chothia | WDSRVPTNW (SEQ ID NO: 402) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTNW (SEQ ID NO: 402) |
| Clone Designation | PGT121.19 hIgG1/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 215) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPTLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 301) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |

TABLE 1-continued

| | |
|---|---|
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.18 hIgG1/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 216) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SSVTSYVSDISVAPGETARISCGEKSLGSRAVQWYQHRAGQAPSLIIYNNQDRPSGIPE RFSGSPDSPFGTTATLTITSVEAGDEADYYCHIWDSRVPTKWVFGGGTTLTVLGQPKA APSVTLFPPSSEELQANKATLVCLISDFYPGAVTVAWKADSSPVKAGVETTTPSKQSNN KYAASSYLSLTPEQWKSHRSYSCQVTHEGSTVEKTVAPTECS (SEQ ID NO: 302) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.17 hIgG1/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE |

TABLE 1-continued

|   |   |
|---|---|
|   | KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 217) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SYVLTQPSDISVAPGETARISCGEKSLGSRAVQWYQHRAGQAPSLIIYNNQDRPSGIPE<br>RFSGSPDSPFGTTATLTITSVEAGDEADYYCHIWDSRVPTKWVFGGGTTLTVLGQPKA<br>APSVTLFPPSSEELQANKATLVCLISDFYPGAVTVAWKADSSPVKAGVETTTPSKQSNN<br>KYAASSYLSLTPEQWKSHRSYSCQVTHEGSTVEKTVAPTECS (SEQ ID NO: 303) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.16 hIgG1/hLambda |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGQGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPIE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 218) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |

TABLE 1-continued

| | |
|---|---|
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 304) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.15 hIgG1/hLambda |
| Heavy Chain | QMQLQESGPGLVKPSETLSLTCSVSGASISDSYWSWIRRSPGKGLEWIGYVHKSGDT NYSPSLKSRVNLSDTSKNQVSLSLVAATAADSGKYYCARTLHGRRIYGIVAFNEWFTY FYMDVWGKGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 219) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |

TABLE 1-continued

| | |
|---|---|
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 305) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.14 hIgG1/hLambda |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNELFTYF<br>YMDVWGNGTQVTVSSASTKGPSVFPLAPSSKSTSGGTAALGCLVKDYFPEPVTVSWN<br>SGALTSGVHTFPAVLQSSGLYSLSSVVTVPSSSLGTQTYICNVNHKPSNTKVDKKVEPK<br>SCDKTHTCPPCPAPELLGGPSVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPIE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 220) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNELFTYFYMDV (SEQ ID NO: 369) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNELFTYFYMDV (SEQ ID NO: 378) |
| Heavy CDR1 Chothia | GASISDS (SEQ ID NO: 379) |
| Heavy CDR2 Chothia | KSG |
| Heavy CDR3 Chothia | LHGRRIYGIVAFNELFTYFYMD (SEQ ID NO: 383) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNELFTYFYMD (SEQ ID NO: 392) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 306) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |

TABLE 1-continued

| | |
|---|---|
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.13 hIgG1/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEAFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 221) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEAFTYFYMDV (SEQ ID NO: 369) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEAFTYFYMDV (SEQ ID NO: 377) |
| Heavy CDR1 Chothia | GASISDS (SEQ ID NO: 379) |
| Heavy CDR2 Chothia | KSG |
| Heavy CDR3 Chothia | LHGRRIYGIVAFNEAFTYFYMD (SEQ ID NO: 383) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEAFTYFYMD (SEQ ID NO: 392) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 307) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |

TABLE 1-continued

| Clone Designation | PGT121.12 hIgG1/hLambda |
|---|---|
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGTYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 222) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 308) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.11 hIgG1/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLTSVTAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 223) |
| Heavy CDR1 Kabat | DSYWS (SEQ ID NO: 362) |
| Heavy CDR2 Kabat | YVHKSGDTNYSPSLKS (SEQ ID NO: 364) |

TABLE 1-continued

| | |
|---|---|
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 309) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.10 hIgG1/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLKLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 224) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |

TABLE 1-continued

| | |
|---|---|
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 310) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.9 hIgG1/hLambda |
| Heavy Chain | QMQLQESGPGLVKPSETLSLTCSVSGASISDSYWSWIRRSPGKGLEWIGYVHKSGDT<br>NYSPSLKSRVHLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPIE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 225) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 311) |
| Light CDR1 Kabat | GEKSLGSRAVQ (SEQ ID NO: 395) |
| Light CDR2 Kabat | NNQDRPS (SEQ ID NO: 396) |

| | |
|---|---|
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.8 hIgG1/hLambda |
| Heavy Chain | QMQLQESGPGLVKPSETLSLTCSVSGASISDSYWSWIRRSPGKGLEWIGYVHKSGDT NYSPSLKSRVTLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 226) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 312) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |

TABLE 1-continued

| | |
|---|---|
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.7 hIgG1/hLambda |
| Heavy Chain | QMQLQESGPGLVKPSETLSLTCSVSGASISDSYWSWIRRSPGKGLEWIGYVHKSGDT<br>NYNPSLKSRVNLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPIE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 227) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 313) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.6 hIgG1/hLambda |
| Heavy Chain | QMQLQESGPGLVKPSETLSLTCSVSGASISDSYWSWIRQSPGKGLEWIGYVHKSGDT<br>NYSPSLKSRVNLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPIE |

TABLE 1-continued

|  |  |
|---|---|
|  | KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 228) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQQRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 314) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.5 hIgG1/hLambda |
| Heavy Chain | QMQLQESGPGLVKPSETLSLTCSVSGASISDAYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 229) |
| Heavy CDR1 Kabat | DAYWS (SEQ ID NO: 363) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDAY (SEQ ID NO: 372) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |

TABLE 1-continued

| | |
|---|---|
| Heavy CDR1 Chothia | GASISDA (SEQ ID NO: 380) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDAY (SEQ ID NO: 386) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 315) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.4 hIgG1/hLambda |
| Heavy Chain | QMQLQESGPGLVKPSETLSLTCSVSGGSISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 230) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GGSISDSY (SEQ ID NO: 373) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GGSISDS (SEQ ID NO: 381) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGGSISDSY (SEQ ID NO: 387) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |

TABLE 1-continued

| | |
|---|---|
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 316) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.3 hIgG1/hLambda |
| Heavy Chain | QVQLQESGPGLVKPSETLSLTCSVSGASISDSYWSWIRRSPGKGLEWIGYVHKSGDTN<br>YSPSLKSRVNLSLDTSKNQVSLSLVAATAADSGKYYCARTLHGRRIYGIVAFNEWFTYF<br>YMDVWGNGTQVTVSSASTKGPSVFPLAPSSKSTSGGTAALGCLVKDYFPEPVTVSWN<br>SGALTSGVHTFPAVLQSSGLYSLSSVVTVPSSSLGTQTYICNVNHKPSNTKVDKKVEPK<br>SCDKTHTCPPCPAPELLGGPSVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPIE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 231) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 317) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |

TABLE 1-continued

| | |
|---|---|
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.2 hIgG1/hLambda |
| Heavy Chain | EMQLQESGPGLVKPSETLSLTCSVSGASISDSYWSWIRRSPGKGLEWIGYVHKSGDTN YSPSLKSRVNLSLDTSKNQVSLSLVAATAADSGKYYCARTLHGRRIYGIVAFNEWFTYF YMDVWGNGTQVTVSSASTKGPSVFPLAPSSKSTSGGTAALGCLVKDYFPEPVTVSWN SGALTSGVHTFPAVLQSSGLYSLSSVVTVPSSSLGTQTYICNVNHKPSNTKVDKKVEPK SCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 232) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 318) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |

TABLE 1-continued

| | |
|---|---|
| Clone Designation | PGT121.32 hIgG1/hLambda |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGTGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPIE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 233) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 319) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.31 hIgG1/hLambda |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGHGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLGGPSVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPIE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 234) |
| Heavy CDR1 Kabat | DSYWS (SEQ ID NO: 362) |
| Heavy CDR2 Kabat | YVHKSGDTNYSPSLKS (SEQ ID NO: 364) |

TABLE 1-continued

| | |
|---|---|
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 320) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |

| | |
|---|---|
| Clone Designation | PGT121.30 hIgG1/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGAGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 235) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |

TABLE 1-continued

| | |
|---|---|
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 321) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.29 hIgG1/hLambda |
| Heavy Chain | QMQLQESGPGLVKPSETLSLTCSVSGASISDSYWSWIRRSPGKGLEWIGYVHKSGDT NYSPSLKSRVALSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 236) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 322) |
| Light CDR1 Kabat | GEKSLGSRAVQ (SEQ ID NO: 395) |
| Light CDR2 Kabat | NNQDRPS (SEQ ID NO: 396) |

| | |
|---|---|
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.28 hIgG1/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLTGVTAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 237) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 323) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |

TABLE 1-continued

| | |
|---|---|
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.27 hIgG1/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLSSVTAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 238) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 324) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.26 hIgG1/hLambda |
| Heavy Chain | QMQLQESGPGLVKPSETLSLTCSVSGASISDSYWSWIRRSPGKGLEWIGYVHKSGDT NYAPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE |

| | |
|---|---|
| | KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 239) |
| Heavy CDR1 Kabat | DSYWS (SEQ ID NO: 362) |
| Heavy CDR2 Kabat | YVHKSGDTNYAPSLKS (SEQ ID NO: 365) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYAPSLKSR (SEQ ID NO: 389) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 325) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.25 hIgG1/hLambda |
| Heavy Chain | QMQLQESGPGLVKPSETLSLTCSVSGASISDSYWSWIRQSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 240) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |

TABLE 1-continued

| | |
|---|---|
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 326) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |

| | |
|---|---|
| Clone Designation | PGT121.57 hIgG1/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLSSVTAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 241) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |

TABLE 1-continued

| | |
|---|---|
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 327) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.56 hIgG1/hLambda |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLVAATAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLAGPDVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPLPEE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVLHEALHSHYTQKSLSLSPGK<br>(SEQ ID NO: 242) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 328) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |

TABLE 1-continued

| | |
|---|---|
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.33 hIgG1/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLSSVTAADSGKYYCARTLHGRRIYGIVAFNEWFTY FYMDVWGKGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 243) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 329) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |

TABLE 1-continued

| | |
|---|---|
| Clone Designation | PGT121.34 hIgG1/hLambda |
| Heavy Chain | QMQLQESGPGLVKPSETLSLTCSVSGASISDSYWSWIRRSPGKGLEWIGYVHKSGDT<br>NYSPSLKSRVNLSLDTSKNQVSLSLSSVTAADSGKYYCARTLHGRRIYGIVAFNEWFTY<br>FYMDVWGHGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLAGPDVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPLPEE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVLHEALHSHYTQKSLSLSPGK<br>(SEQ ID NO: 244) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 330) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.35 hIgG1/hLambda |
| Heavy Chain | QMQLQESGPGLVKPSETLSLTCSVSGASISDSYWSWIRRSPGKGLEWIGYVHKSGDT<br>NYSPSLKSRVHLSLDTSKNQVSLSLSSVTAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLAGPDVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPLPEE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVLHEALHSHYTQKSLSLSPGK<br>(SEQ ID NO: 245) |
| Heavy CDR1 Kabat | DSYWS (SEQ ID NO: 362) |
| Heavy CDR2 Kabat | YVHKSGDTNYSPSLKS (SEQ ID NO: 364) |

TABLE 1-continued

| | |
|---|---|
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 331) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.36 hIgG1/hLambda |
| Heavy Chain | QMQLQESGPGLVKPSETLSLTCSVSGASISDSYWSWIRRSPGKGLEWIGYVHKSGDT NYSPSLKSRVHLSLDTSKNQVSLSLSSVTAADSGKYYCARTLHGRRIYGIVAFNEWFTY FYMDVWGKGTQVTSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 246) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |

TABLE 1-continued

| | |
|---|---|
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 332) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.37 hIgG1/hLambda |
| Heavy Chain | QMQLQESGPGLVKPSETLSLTCSVSGASISDSYWSWIRRSPGKGLEWIGYVHKSGDT NYSPSLKSRVHLSLDTSKNQVSLSLSSVTAADSGKYYCARTLHGRRIYGIVAFNEWFTY FYMDVWGHGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 247) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 333) |
| Light CDR1 Kabat | GEKSLGSRAVQ (SEQ ID NO: 395) |
| Light CDR2 Kabat | NNQDRPS (SEQ ID NO: 396) |

| | |
|---|---|
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.38 hIgG1/hLambda |
| Heavy Chain | QMQLQESGPGLVKPSETLSLTCSVSGASISDSYWSWIRRSPGKGLEWIGYVHKSGDT NYNPSLKSRVNLSLDTSKNQVSLSLSSVTAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 248) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 334) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |

TABLE 1-continued

| | |
|---|---|
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.39 hIgG1/hLambda |
| Heavy Chain | QMQLQESGPGLVKPSETLSLTCSVSGASISDSYWSWIRRSPGKGLEWIGYVHKSGDT NYNPSLKSRVNLSLDTSKNQVSLSLSSVTAADSGKYYCARTLHGRRIYGIVAFNEWFTY FYMDVWGKGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 249) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 335) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.40 hIgG1/hLambda |
| Heavy Chain | QMQLQESGPGLVKPSETLSLTCSVSGASISDSYWSWIRRSPGKGLEWIGYVHKSGDT NYNPSLKSRVNLSLDTSKNQVSLSLSSVTAADSGKYYCARTLHGRRIYGIVAFNEWFTY FYMDVWGHGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE |

TABLE 1-continued

| | |
|---|---|
| | KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 250) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 336) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.41 hIgG1/hLambda |
| Heavy Chain | QMQLQESGPGLVKPSETLSLTCSVSGASISDSYWSWIRRSPGKGLEWIGYVHKSGDT NYNPSLKSRVHLSLDTSKNQVSLSLSSVTAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 251) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |

TABLE 1-continued

| | |
|---|---|
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 337) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.42 hIgG1/hLambda |
| Heavy Chain | QMQLQESGPGLVKPSETLSLTCSVSGASISDSYWSWIRRSPGKGLEWIGYVHKSGDT NYNPSLKSRVHLSLDTSKNQVSLSLSSVTAADSGKYYCARTLHGRRIYGIVAFNEWFTY FYMDVWGKGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 252) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |

TABLE 1-continued

| | |
|---|---|
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 338) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.42 hIgG1 (FEAQS)/hLambda |
| Heavy Chain | QMQLQESGPGLVKPSETLSLTCSVSGASISDSYWSWIRRSPGKGLEWIGYVHKSGDT<br>NYNPSLKSRVHLSLDTSKNQVSLSLSSVTAADSGKYYCARTLHGRRIYGIVAFNEWFTY<br>FYMDVWGKGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPEFEGGPSVFLFPPKPKDTLMISRTPEVTCVVVAVSHEDPEVKFN<br>WYVDGVEVHNAKTKPREEQYQSTYRVVSVLTVLHQDWLNGKEYKCKVSNKALPASIE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 253) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 339) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |

TABLE 1-continued

| | |
|---|---|
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.42 hIgG1 (WT Fc)/hLambda |
| Heavy Chain | QMQLQESGPGLVKPSETLSLTCSVSGASISDSYWSWIRRSPGKGLEWIGYVHKSGDT NYNPSLKSRVHLSLDTSKNQVSLSLSSVTAADSGKYYCARTLHGRRIYGIVAFNEWFTY FYMDVWGKGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 254) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 340) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |

TABLE 1-continued

| Clone Designation | PGT121.43 hIgG1/hLambda |
|---|---|
| Heavy Chain | QMQLQESGPGLVKPSETLSLTCSVSGASISDSYWSWIRRSPGKGLEWIGYVHKSGDT<br>NYNPSLKSRVHLSLDTSKNQVSLSLSSVTAADSGKYYCARTLHGRRIYGIVAFNEWFTY<br>FYMDVWGHGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLAGPDVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPLPEE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVLHEALHSHYTQKSLSLSPGK<br>(SEQ ID NO: 255) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 341) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.44 hIgG1/hLambda |
| Heavy Chain | QMQLQESGPGLVKPSETLSLTCSVSGASISDSYWSWIRQSPGKGLEWIGYVHKSGDT<br>NYSPSLKSRVNLSLDTSKNQVSLSLSSVTAADSGKYYCARTLHGRRIYGIVAFNEWFTY<br>FYMDVWGNGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLAGPDVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPLPEE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVLHEALHSHYTQKSLSLSPGK<br>(SEQ ID NO: 256) |
| Heavy CDR1 Kabat | DSYWS (SEQ ID NO: 362) |
| Heavy CDR2 Kabat | YVHKSGDTNYSPSLKS (SEQ ID NO: 364) |

TABLE 1-continued

| | |
|---|---|
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 342) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.45 hIgG1/hLambda |
| Heavy Chain | QMQLQESGPGLVKPSETLSLTCSVSGASISDSYWSWIRQSPGKGLEWIGYVHKSGDT NYSPSLKSRVNLSLDTSKNQVSLSLSSVTAADSGKYYCARTLHGRRIYGIVAFNEWFTY FYMDVWGKGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 257) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |

TABLE 1-continued

| | |
|---|---|
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 343) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.46 hIgG1/hLambda |
| Heavy Chain | QMQLQESGPGLVKPSETLSLTCSVSGASISDSYWSWIRQSPGKGLEWIGYVHKSGDT NYSPSLKSRVNLSLDTSKNQVSLSLSSVTAADSGKYYCARTLHGRRIYGIVAFNEWFTY FYMDVWGHGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 258) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 344) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |

TABLE 1-continued

| | |
|---|---|
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.47 hIgG1/hLambda |
| Heavy Chain | QMQLQESGPGLVKPSETLSLTCSVSGASISDSYWSWIRQSPGKGLEWIGYVHKSGDT NYSPSLKSRVHLSLDTSKNQVSLSLSSVTAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 259) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 345) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |

TABLE 1-continued

| | |
|---|---|
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.48 hIgG1/hLambda |
| Heavy Chain | QMQLQESGPGLVKPSETLSLTCSVSGASISDSYWSWIRQSPGKGLEWIGYVHKSGDT NYSPSLKSRVHLSLDTSKNQVSLSLSSVTAADSGKYYCARTLHGRRIYGIVAFNEWFTY FYMDVWGKGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 260) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 346) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.49 hIgG1/hLambda |
| Heavy Chain | QMQLQESGPGLVKPSETLSLTCSVSGASISDSYWSWIRQSPGKGLEWIGYVHKSGDT NYSPSLKSRVHLSLDTSKNQVSLSLSSVTAADSGKYYCARTLHGRRIYGIVAFNEWFTY FYMDVWGHGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 261) |

TABLE 1-continued

| | |
|---|---|
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 347) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.50 hIgG1/hLambda |
| Heavy Chain | QMQLQESGPGLVKPSETLSLTCSVSGASISDSYWSWIRQSPGKGLEWIGYVHKSGDT NYNPSLKSRVNLSLDTSKNQVSLSLSSVTAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 262) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |

TABLE 1-continued

| | |
|---|---|
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 348) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.51 hIgG1/hLambda |
| Heavy Chain | QMQLQESGPGLVKPSETLSLTCSVSGASISDSYWSWIRQSPGKGLEWIGYVHKSGDT NYNPSLKSRVNLSLDTSKNQVSLSLSSVTAADSGKYYCARTLHGRRIYGIVAFNEWFTY FYMDVWGKGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 263) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 349) |

TABLE 1-continued

| | |
|---|---|
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.52 hIgG1/hLambda |
| Heavy Chain | QMQLQESGPGLVKPSETLSLTCSVSGASISDSYWSWIRQSPGKGLEWIGYVHKSGDT NYNPSLKSRVNLSLDTSKNQVSLSLSSVTAADSGKYYCARTLHGRRIYGIVAFNEWFTY FYMDVWGHGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 264) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 350) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |

TABLE 1-continued

| | |
|---|---|
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.53 hIgG1/hLambda |
| Heavy Chain | QMQLQESGPGLVKPSETLSLTCSVSGASISDSYWSWIRQSPGKGLEWIGYVHKSGDT NYNPSLKSRVHLSLDTSKNQVSLSLSSVTAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 265) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 351) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.54 hIgG1/hLambda |
| Heavy Chain | QMQLQESGPGLVKPSETLSLTCSVSGASISDSYWSWIRQSPGKGLEWIGYVHKSGDT NYNPSLKSRVHLSLDTSKNQVSLSLSSVTAADSGKYYCARTLHGRRIYGIVAFNEWFTY FYMDVWGKGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP |

| | |
|---|---|
| | KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 266) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 352) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.55 hIgG1/hLambda |
| Heavy Chain | QMQLQESGPGLVKPSETLSLTCSVSGASISDSYWSWIRQSPGKGLEWIGYVHKSGDT NYNPSLKSRVHLSLDTSKNQVSLSLSSVTAADSGKYYCARTLHGRRIYGIVAFNEWFTY FYMDVWGHGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 267) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |

TABLE 1-continued

| | |
|---|---|
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 353) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.65 hIgG1/hLambda |
| Heavy Chain | QLQLQESGPGLVKPSETLSLTCSVSGASISDAYWSWIRRSPGKGLEWIGYVHKSGDTN YNPSLKSRVHLSLDTSKNQVSLSLTGVTAADSGKYYCARALHGRRIYGIVAFNEWFTYF YMDVWGTGTQVTVSSASTKGPSVFPLAPSSKSTSGGTAALGCLVKDYFPEPVTVSWN SGALTSGVHTFPAVLQSSGLYSLSSVVTVPSSSLGTQTYICNVNHKPSNTKVDKKVEPK SCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 268) |
| Heavy CDR1 Kabat | DAYWS (SEQ ID NO: 363) |
| Heavy CDR2 Kabat | YVHKSGDTNYNPSLKS (SEQ ID NO: 366) |
| Heavy CDR3 Kabat | ALHGRRIYGIVAFNEWFTYFYMDV (SEQ ID NO: 368) |
| Heavy CDR1 IMGT | GASISDAY (SEQ ID NO: 372) |
| Heavy CDR2 IMGT | VHKSGDT (SEQ ID NO: 374) |
| Heavy CDR3 IMGT | ARALHGRRIYGIVAFNEWFTYFYMDV (SEQ ID NO: 376) |
| Heavy CDR1 Chothia | GASISDA (SEQ ID NO: 380) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDAY (SEQ ID NO: 386) |
| Heavy CDR2 Honegger | VHKSGDTNYNPSLKSR (SEQ ID NO: 390) |
| Heavy CDR3 Honegger | ALHGRRIYGIVAFNEWFTYFYMD (SEQ ID NO: 392) |

TABLE 1-continued

| | |
|---|---|
| Light Chain | SDISVAPGETARISCGEKSLGSRAVQWYQHRAGQAPSLIIYNNQDRPSGIPERFSGSPD<br>SRPGTTATLTITSVEAGDEADYYCHIWDSRVPTKWVFGGGTKLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 354) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.64 hIgG1/hLambda |
| Heavy Chain | QLQLQESGPGLVKPSETLSLTCSVSGASISDAYWSWIRRSPGKGLEWIGYVHKSGDTN<br>YNPSLKSRVHLSLDTSKNQVSLSLTGVTAADSGKYYCARALHGRRIYGIVAFNEWFTYF<br>YMDVWGTGTQVTVSSASTKGPSVFPLAPSSKSTSGGTAALGCLVKDYFPEPVTVSWN<br>SGALTSGVHTFPAVLQSSGLYSLSSVVTVPSSSLGTQTYICNVNHKPSNTKVDKKVEPK<br>SCDKTHTCPPCPAPELLAGPDVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPLPEE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVLHEALHSHYTQKSLSLSPGK<br>(SEQ ID NO: 269) |
| Heavy CDR1 Kabat | DAYWS (SEQ ID NO: 363) |
| Heavy CDR2 Kabat | YVHKSGDTNYNPSLKS (SEQ ID NO: 366) |
| Heavy CDR3 Kabat | ALHGRRIYGIVAFNEWFTYFYMDV (SEQ ID NO: 368) |
| Heavy CDR1 IMGT | GASISDAY (SEQ ID NO: 372) |
| Heavy CDR2 IMGT | VHKSGDT (SEQ ID NO: 374) |
| Heavy CDR3 IMGT | ARALHGRRIYGIVAFNEWFTYFYMDV (SEQ ID NO: 376) |
| Heavy CDR1 Chothia | GASISDA (SEQ ID NO: 380) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDAY (SEQ ID NO: 386) |
| Heavy CDR2 Honegger | VHKSGDTNYNPSLKSR (SEQ ID NO: 390) |
| Heavy CDR3 Honegger | ALHGRRIYGIVAFNEWFTYFYMD (SEQ ID NO: 392) |
| Light Chain | SDISVAPGETARISCGEKSLGSRAVQWYQHRAGQAPSLIIYNNQDRPSGIPERFSGSPD<br>SRPGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 355) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |

TABLE 1-continued

| | |
|---|---|
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.63 hIgG1/hLambda |
| Heavy Chain | QLQLQESGPGLVKPSETLSLTCSVSGASISDAYWSWIRRSPGKGLEWIGYVHKSGDTN YNPSLKSRVHLSLDTSKNQVSLSLTGVTAADSGKYYCARALHGRRIYGIVAFNEWFTYF YMDVWGTGTQVTVSSASTKGPSVFPLAPSSKSTSGGTAALGCLVKDYFPEPVTVSWN SGALTSGVHTFPAVLQSSGLYSLSSVVTVPSSSLGTQTYICNVNHKPSNTKVDKKVEPK SCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 270) |
| Heavy CDR1 Kabat | DAYWS (SEQ ID NO: 363) |
| Heavy CDR2 Kabat | YVHKSGDTNYNPSLKS (SEQ ID NO: 366) |
| Heavy CDR3 Kabat | ALHGRRIYGIVAFNEWFTYFYMDV (SEQ ID NO: 368) |
| Heavy CDR1 IMGT | GASISDAY (SEQ ID NO: 372) |
| Heavy CDR2 IMGT | VHKSGDT (SEQ ID NO: 374) |
| Heavy CDR3 IMGT | ARALHGRRIYGIVAFNEWFTYFYMDV (SEQ ID NO: 376) |
| Heavy CDR1 Chothia | GASISDA (SEQ ID NO: 380) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDAY (SEQ ID NO: 386) |
| Heavy CDR2 Honegger | VHKSGDTNYNPSLKSR (SEQ ID NO: 390) |
| Heavy CDR3 Honegger | ALHGRRIYGIVAFNEWFTYFYMD (SEQ ID NO: 392) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTKLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 356) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |

TABLE 1-continued

| Clone Designation | PGT121.62 hIgG1/hLambda |
|---|---|
| Heavy Chain | QLQLQESGPGLVKPSETLSLTCSVSGASISDAYWSWIRRSPGKGLEWIGYVHKSGDTN<br>YNPSLKSRVHLSLDTSKNQVSLSLTGVTAADSGKYYCARALHGRRIYGIVAFNEWFTYF<br>YMDVWGTGTQVTVSSASTKGPSVFPLAPSSKSTSGGTAALGCLVKDYFPEPVTVSWN<br>SGALTSGVHTFPAVLQSSGLYSLSSVVTVPSSSLGTQTYICNVNHKPSNTKVDKKVEPK<br>SCDKTHTCPPCPAPELLAGPDVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPLPEE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVLHEALHSHYTQKSLSLSPGK<br>(SEQ ID NO: 271) |
| Heavy CDR1 Kabat | DAYWS (SEQ ID NO: 363) |
| Heavy CDR2 Kabat | YVHKSGDTNYNPSLKS (SEQ ID NO: 366) |
| Heavy CDR3 Kabat | ALHGRRIYGIVAFNEWFTYFYMDV (SEQ ID NO: 368) |
| Heavy CDR1 IMGT | GASISDAY (SEQ ID NO: 372) |
| Heavy CDR2 IMGT | VHKSGDT (SEQ ID NO: 374) |
| Heavy CDR3 IMGT | ARALHGRRIYGIVAFNEWFTYFYMDV (SEQ ID NO: 376) |
| Heavy CDR1 Chothia | GASISDA (SEQ ID NO: 380) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDAY (SEQ ID NO: 386) |
| Heavy CDR2 Honegger | VHKSGDTNYNPSLKSR (SEQ ID NO: 390) |
| Heavy CDR3 Honegger | ALHGRRIYGIVAFNEWFTYFYMD (SEQ ID NO: 392) |
| Light Chain | SDISVAPGETARISCGEKSLGSRAVQWYQHRAGQAPSLIIYNNQDRPSGIPERFSGSPD<br>SPFGTTATLTITSVEAGDEADYYCHIWDSRVPTKWVFGGGTTLTVLGQPKAAPSVTLFP<br>PSSEELQANKATLVCLISDFYPGAVTVAWKADSSPVKAGVETTTPSKQSNNKYAASSYL<br>SLTPEQWKSHRSYSCQVTHEGSTVEKTVAPTECS (SEQ ID NO: 357) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.61 hIgG1/hLambda |
| Heavy Chain | QMQLQESGPGLVKPSETLSLTCSVSGASISDSYWSWIRRSPGKGLEWIGYVHKSGDT<br>NYNPSLKSRVHLSLDTSKNQVSLSLTGVTAADSGKYYCARTLHGRRIYGIVAFNEWFTY<br>FYMDVWGTGTQVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKKVEP<br>KSCDKTHTCPPCPAPELLAGPDVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPLPEE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVLHEALHSHYTQKSLSLSPGK<br>(SEQ ID NO: 272) |
| Heavy CDR1 Kabat | DSYWS (SEQ ID NO: 362) |
| Heavy CDR2 Kabat | YVHKSGDTNYNPSLKS (SEQ ID NO: 366) |

TABLE 1-continued

| | |
|---|---|
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SRPGTTATLTITSVEAGDEADYYCHIWDSRVPTKWVFGGGTKLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 358) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.60 hIgG1/hLambda |
| Heavy Chain | QMQLQESGPGLVKPSETLSLTCSVSGASISDSYWSWIRRSPGKGLEWIGYVHKSGDT NYNPSLKSRVHLSLDTSKNQVSLSLTGVTAADSGKYYCARTLHGRRIYGIVAFNEWFTY FYMDVWGTGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 273) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |

TABLE 1-continued

| | |
|---|---|
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SRPGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 359) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.59 hIgG1/hLambda |
| Heavy Chain | QMQLQESGPGLVKPSETLSLTCSVSGASISDSYWSWIRRSPGKGLEWIGYVHKSGDT NYNPSLKSRVHLSLDTSKNQVSLSLTGVTAADSGKYYCARTLHGRRIYGIVAFNEWFTY FYMDVWGTGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 274) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTKLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 360) |
| Light CDR1 Kabat | GEKSLGSRAVQ (SEQ ID NO: 395) |
| Light CDR2 Kabat | NNQDRPS (SEQ ID NO: 396) |

| | |
|---|---|
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.58 hIgG1/hLambda |
| Heavy Chain | QMQLQESGPGLVKPSETLSLTCSVSGASISDSYWSWIRRSPGKGLEWIGYVHKSGDT NYNPSLKSRVHLSLDTSKNQVSLSLTGVTAADSGKYYCARTLHGRRIYGIVAFNEWFTY FYMDVWGTGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGK (SEQ ID NO: 275) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 361) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |

| | |
|---|---|
| Light CDR2 Honegger | NNQDRPSGIPER (SEQ ID NO: 403) |
| Light CDR3 Honegger | WDSRVPTKW (SEQ ID NO: 401) |
| Clone Designation | PGT123 hIgG1/hLambda |
| Heavy Chain | QLHLQESGPGLVKPPETLSLTCSVSGASINDAYWSWIRQSPGKRPEWVGYVHHSGDT NYNPSLKRRVTFSLDTAKNEVSLKLVDLTAADSATYFCARALHGKRIYGIVALGELFTYF YMDVWGKGTAVTVSSASTKGPSVFPLAPSSKSTSGGTAALGCLVKDYFPEPVTVSWN SGALTSGVHTFPAVLQSSGLYSLSSVVTVPSSSLGTQTYICNVNHKPSNTKVDKKVEPK SCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 404) |
| Heavy CDR1 Kabat | DAYWS (SEQ ID NO: 363) |
| Heavy CDR2 Kabat | YVHKSGDTNYNPSLKS (SEQ ID NO: 405) |
| Heavy CDR3 Kabat | ALHGKRIYGIVALGELFTYFYMDV (SEQ ID NO: 406) |
| Heavy CDR1 IMGT | GASINDAY (SEQ ID NO: 407) |
| Heavy CDR2 IMGT | VHHSGDT (SEQ ID NO: 408) |
| Heavy CDR3 IMGT | ARALHGKRIYGIVALGELFTYFYMDV (SEQ ID NO: 409) |
| Heavy CDR1 Chothia | GASINDA (SEQ ID NO: 410) |
| Heavy CDR2 Chothia | HSG |
| Heavy CDR3 Chothia | LHGKRIYGIVALGELFTYFYMD (SEQ ID NO: 411) |
| Heavy CDR1 Honegger | VSGASINDAY (SEQ ID NO: 412) |
| Heavy CDR2 Honegger | VHHSGDTNYNPSLKRR (SEQ ID NO: 413) |
| Heavy CDR3 Honegger | ALHGKRIYGIVALGELFTYFYMD (SEQ ID NO: 414) |
| Light Chain | SSMSVSPGETAKISCGKESIGSRAVQWYQQKPGQPPSLIIYNNQDRPAGVPERFSASP DFRPGTTATLTITNVDAEDEADYYCHIYDARGGTNWVFDRGTTLTVLGQPKAAPSVTLF PPSSEELQANKATLVCLISDFYPGAVTVAWKADSSPVKAGVETTTPSKQSNNKYAASS YLSLTPEQWKSHRSYSCQVTHEGSTVEKTVAPTECS (SEQ ID NO: 415) |
| Light CDR1 Kabat | GKESIGSRAVQ (SEQ ID NO: 416) |
| Light CDR2 Kabat | NNQDRPA (SEQ ID NO: 417) |
| Light CDR3 Kabat | HIYDARGGTNWV (SEQ ID NO: 418) |
| Light CDR1 IMGT | SIGSRA (SEQ ID NO: 419) |
| Light CDR2 IMGT | NNQ |
| Light CDR3 IMGT | HIYDARGGTNWV (SEQ ID NO: 418) |
| Light CDR1 Chothia | KESIGSRA (SEQ ID NO: 420) |
| Light CDR2 Chothia | NNQ |
| Light CDR3 Chothia | YDARGGTNW (SEQ ID NO: 421) |
| Light CDR1 Honegger | KESIGSRA (SEQ ID NO: 420) |
| Light CDR2 Honegger | NNQDRPAGVPER (SEQ ID NO: 422) |
| Light CDR3 Honegger | YDARGGTNW (SEQ ID NO: 421) |
| Clone Designation | PGT121 hIgG1 (Avi)/hLambda |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE |

TABLE 1-continued

|  |  |
|---|---|
|  | KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGKG GSGGLNDIFEAQKIEWHE (SEQ ID NO: 423) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 424) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT121.42 hIgG1 (Avi)/hLambda |
| Heavy Chain | QMQLQESGPGLVKPSETLSLTCSVSGASISDSYWSWI RRSPGKGLEWIGYVHKSGDT NYNPSLKSRVHLSLDTSKNQVSLSLSSVTAADSGKYYCARTLHGRRIYGIVAFNEWFTY FYMDVWGKGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKKVEP KSCDKTHTCPPCPAPELLAGPDVFLFPPKPKDTLMISRTPEVTCVVVDVSHEDPEVKFN WYVDGVEVHNAKTKPREEQYNSTYRVVSVLTVLHQDWLNGKEYKCKVSNKALPLPEE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVLHEALHSHYTQKSLSLSPGKGG SGGLNDIFEAQKIEWHE (SEQ ID NO: 425) |
| Heavy CDR1 Kabat | DSYWS (SEQ ID NO: 362) |
| Heavy CDR2 Kabat | YVHKSGDTNYNPSLKS (SEQ ID NO: 366) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |

TABLE 1-continued

| | |
|---|---|
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYNPSLKSR (SEQ ID NO: 390) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHRSYSCQVTHEGSTVEKTVAPTECS (SEQ ID NO: 426) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |
| Clone Designation | PGT123 hIgG1/hLambda(TC) |
| Heavy Chain | QLHLQESGPGLVKPPETLSLTCSVSGASINDAYWSWIRQSPGKRPEWVGYVHHSGDT NYNPSLKRRVTFSLDTAKNEVSLKLVDLTAADSATYFCARALHGKRIYGIVALGELFTYF YMDVWGKGTAVTVSSASTKGPSVFPLAPSSKSTSGGTAALGCLVKDYFPEPVTVSWN SGALTSGVHTFPAVLQSSGLYSLSSVVTVPSSSLGTQTYICNVNHKPSNTKVDKRVEPK SCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 427) |
| Heavy CDR1 Kabat | DAYWS (SEQ ID NO: 363) |
| Heavy CDR2 Kabat | YVHKSGDTNYNPSLKS (SEQ ID NO: 405) |
| Heavy CDR3 Kabat | ALHGKRIYGIVALGELFTYFYMDV (SEQ ID NO: 406) |
| Heavy CDR1 IMGT | GASINDAY (SEQ ID NO: 407) |
| Heavy CDR2 IMGT | VHHSGDT (SEQ ID NO: 408) |
| Heavy CDR3 IMGT | ARALHGKRIYGIVALGELFTYFYMDV (SEQ ID NO: 409) |
| Heavy CDR1 Chothia | GASINDA (SEQ ID NO: 410) |
| Heavy CDR2 Chothia | HSG |
| Heavy CDR3 Chothia | LHGKRIYGIVALGELFTYFYMD (SEQ ID NO: 411) |
| Heavy CDR1 Honegger | VSGASINDAY (SEQ ID NO: 412) |
| Heavy CDR2 Honegger | VHHSGDTNYNPSLKRR (SEQ ID NO: 413) |
| Heavy CDR3 Honegger | ALHGKRIYGIVALGELFTYFYMD (SEQ ID NO: 414) |

TABLE 1-continued

| | |
|---|---|
| Light Chain | SSMSVSPGETAKISCGKESIGSRAVQWYQQKPGQPPSLIIYNNQDRPAGVPERFSASP<br>DFRPGTTATLTITNVDAEDEADYYCHIYDARGGTNWVFDRGTTLTVLGQPKAAPSVTLF<br>PPSSEELQANKATLVCLISDFYPGAVTVAWKADSSPVKAGVETTTPSKQSNNKYAASS<br>YLSLTPEQWKSHKSYSCQVTHEGSTVEKTVAPTECS (SEQ ID NO: 428) |
| Light CDR1 Kabat | GKESIGSRAVQ (SEQ ID NO: 416) |
| Light CDR2 Kabat | NNQDRPA (SEQ ID NO: 417) |
| Light CDR3 Kabat | HIYDARGGTNWV (SEQ ID NO: 418) |
| Light CDR1 IMGT | SIGSRA (SEQ ID NO: 419) |
| Light CDR2 IMGT | NNQ |
| Light CDR3 IMGT | HIYDARGGTNWV (SEQ ID NO: 418) |
| Light CDR1 Chothia | KESIGSRA (SEQ ID NO: 420) |
| Light CDR2 Chothia | NNQ |
| Light CDR3 Chothia | YDARGGTNW (SEQ ID NO: 421) |
| Light CDR1 Honegger | KESIGSRA (SEQ ID NO: 420) |
| Light CDR2 Honegger | NNQDRPAGVPER (SEQ ID NO: 422) |
| Light CDR3 Honegger | YDARGGTNW (SEQ ID NO: 421) |
| Clone Designation | PGT122 hIgG1/hLambda(TC) |
| Heavy Chain | QVHLQESGPGLVKPSETLSLTCNVSGTLVRDNYWSWIRQPLGKOPEWIGYVHDSGDT<br>NYNPSLKSRVHLSLDKSKNLVSLRLTGVTAADSAIYYCATTKHGRRIYGVVAFKEWFTY<br>FYMDVWGKGTSVTVSSASTKGPSVFPLAPSSKSTSGGTAALGCLVKDYFPEPVTVSW<br>NSGALTSGVHTFPAVLQSSGLYSLSSVVTVPSSSLGTQTYICNVNHKPSNTKVDKRVEP<br>KSCDKTHTCPPCPAPELLGGPSVFLFPPKPKDTLMISRTPEVTCVVVDVSHEDPEVKFN<br>WYVDGVEVHNAKTKPREEQYNSTYRVVSVLTVLHQDWLNGKEYKCKVSNKALPAPIE<br>KTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGK<br>(SEQ ID NO: 429) |
| Heavy CDR1 Kabat | DNYWS (SEQ ID NO: 431) |
| Heavy CDR2 Kabat | YVHDSGDTNYNPSLKS (SEQ ID NO: 432) |
| Heavy CDR3 Kabat | TKHGRRIYGVVAFKEWFTYFYMDV (SEQ ID NO: 433) |
| Heavy CDR1 IMGT | GTLVRDNY (SEQ ID NO: 434) |
| Heavy CDR2 IMGT | VHDSGDT (SEQ ID NO: 435) |
| Heavy CDR3 IMGT | ATTKHGRRIYGVVAFKEWFTYFYMDV (SEQ ID NO: 436) |
| Heavy CDR1 Chothia | GTLVRDN (SEQ ID NO: 437) |
| Heavy CDR2 Chothia | DSG |
| Heavy CDR3 Chothia | KHGRRIYGVVAFKEWFTYFYMD (SEQ ID NO: 438) |
| Heavy CDR1 Honegger | VSGTLVRDNY (SEQ ID NO: 439) |
| Heavy CDR2 Honegger | VHDSGDTNYNPSLKSR (SEQ ID NO: 440) |
| Heavy CDR3 Honegger | TKHGRRIYGVVAFKEWFTYFYMD (SEQ ID NO: 441) |
| Light Chain | TFVSVAPGQTARITCGEESLGSRSVIWYQQRPGQAPSLIIYNNNDRPSGIPDRFSGSPG<br>STFGTTATLTITSVEAGDEADYYCHIWDSRRPTNWVFGEGTTLIVLSQPKAAPSVTLFPP<br>SSEELQANKATLVCLISDFYPGAVTVAWKADSSPVKAGVETTTPSKQSNNKYAASSYLS<br>LTPEQWKSHKSYSCQVTHEGSTVEKTVAPTECS (SEQ ID NO: 430) |
| Light CDR1 Kabat | GEESLGSRSVI (SEQ ID NO: 442) |
| Light CDR2 Kabat | NNNDRPS (SEQ ID NO: 443) |
| Light CDR3 Kabat | HIWDSRRPTNWV (SEQ ID NO: 444) |
| Light CDR1 IMGT | SLGSRS (SEQ ID NO: 445) |
| Light CDR2 IMGT | NNN |

TABLE 1-continued

| | |
|---|---|
| Light CDR3 IMGT | HIWDSRRPTNWV (SEQ ID NO: 444) |
| Light CDR1 Chothia | EESLGSRS (SEQ ID NO: 446) |
| Light CDR2 Chothia | NNN |
| Light CDR3 Chothia | WDSRRPTNW (SEQ ID NO: 447) |
| Light CDR1 Honegger | EESLGSRS (SEQ ID NO: 446) |
| Light CDR2 Honegger | NNNDRPSGIPDR (SEQ ID NO: 448) |
| Light CDR3 Honegger | WDSRRPTNW (SEQ ID NO: 447) |
| Clone Designation | PGT121 hIgG1/hLambda(TC) |
| Heavy Chain | QMQLQESGPGLVKPSETLSLTCSVSGASISDSYWSWIRRSPGKGLEWIGYVHKSGDT NYSPSLKSRVNLSLDTSKNQVSLSLVAATAADSGKYYCARTLHGRRIYGIVAFNEWFTY FYMDVWGNGTQVTVSSASTKGPSVFPLAPSSKSTSGGTAALGCLVKDYFPEPVTVSW NSGALTSGVHTFPAVLQSSGLYSLSSVVTVPSSSLGTQTYICNVNHKPSNTKVDKRVEP KSCDKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPIE KTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGK (SEQ ID NO: 449) |
| Heavy CDR1 Kabat | DSYWS (SEQ ID NO: 362) |
| Heavy CDR2 Kabat | YVHKSGDTNYSPSLKS (SEQ ID NO: 364) |
| Heavy CDR3 Kabat | TLHGRRIYGIVAFNEWFTYFYMDV (SEQ ID NO: 367) |
| Heavy CDR1 IMGT | GASISDSY (SEQ ID NO: 371) |
| Heavy CDR2 IMGT | VHKSGDT (SEQ ID NO: 374) |
| Heavy CDR3 IMGT | ARTLHGRRIYGIVAFNEWFTYFYMDV (SEQ ID NO: 375) |
| Heavy CDR1 Chothia | GASISDS (SEQ ID NO: 379) |
| Heavy CDR2 Chothia | KSG |
| Heavy CDR3 Chothia | LHGRRIYGIVAFNEWFTYFYMD (SEQ ID NO: 382) |
| Heavy CDR1 Honegger | VSGASISDSY (SEQ ID NO: 385) |
| Heavy CDR2 Honegger | VHKSGDTNYSPSLKSR (SEQ ID NO: 388) |
| Heavy CDR3 Honegger | TLHGRRIYGIVAFNEWFTYFYMD (SEQ ID NO: 391) |
| Light Chain | SDISVAPGETARISCGEKSLGSRAVQWYQHRAGQAPSLIIYNNQDRPSGIPERFSGSPD SPFGTTATLTITSVEAGDEADYYCHIWDSRVPTKWVFGGGTTLTVLGQPKAAPSVTLFP PSSEELQANKATLVCLISDFYPGAVTVAWKADSSPVKAGVETTTPSKQSNNKYAASSYL SLTPEQWKSHKSYSCQVTHEGSTVEKTVAPTECS (SEQ ID NO: 450) |
| Light CDR1 Kabat | GEKSLGSRAVQ (SEQ ID NO: 395) |
| Light CDR2 Kabat | NNQDRPS (SEQ ID NO: 396) |
| Light CDR3 Kabat | HIWDSRVPTKWV (SEQ ID NO: 397) |
| Light CDR1 IMGT | SLGSRA (SEQ ID NO: 399) |
| Light CDR2 IMGT | NNQ |
| Light CDR3 IMGT | HIWDSRVPTKWV (SEQ ID NO: 397) |
| Light CDR1 Chothia | EKSLGSRA (SEQ ID NO: 400) |
| Light CDR2 Chothia | NNQ |
| Light CDR3 Chothia | WDSRVPTKW (SEQ ID NO: 401) |
| Light CDR1 Honegger | EKSLGSRA (SEQ ID NO: 400) |
| Light CDR2 Honegger | NNQDRPSGIPER (SEQ ID NO: 403) |
| Light CDR3 Honegger | WDSRVPTKW (SEQ ID NO: 401) |

SEQUENCE LISTING (452 sequences)

SEQ ID NO: 1 - protein, 24 aa, Artificial Sequence
  Synthetic heavy chain signal sequence
MDPKGSLSWRILLFLSLAFELSYG

SEQ ID NO: 2 - protein, 20 aa, Artificial Sequence
  Synthetic heavy chain signal sequence
MSVPTQVLGLLLLWLTDARC

SEQ ID NO: 3 - DNA, 1446 bp, Artificial Sequence
  synthetic polynucleotide sequence encoding the gamma heavy chain of PGT-121 LO6
atgaaacacctgtggttcttccttctcctggtggcagctcccagatgggtcctgtcacagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 4 - DNA, 396 bp, Artificial Sequence
  synthetic polynucleotide encoding the gamma heavy chain variable region of PGT-121 LO6
cagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctca

SEQ ID NO: 5 - protein, 5 aa, Artificial Sequence
  Synthetic CDR of PGT antibody
DNYWS

SEQ ID NO: 6 - protein, 6 aa, Artificial Sequence
  Synthetic CDR of PGT antibody
GTLVDR

SEQ ID NO: 7 - protein, 5 aa, Artificial Sequence
  Synthetic CDR of PGT antibody
DAYWS

SEQ ID NO: 8 - protein, 6 aa, Artificial Sequence
  Synthetic CDR of PGT antibody
GASIND

SEQ ID NO: 9 - protein, 5 aa, Artificial Sequence
  Synthetic CDR of PGT antibody
NYYWT

SEQ ID NO: 10 - protein, 6 aa, Artificial Sequence
  Synthetic CDR of PGT antibody
GGSISN

SEQ ID NO: 11 - protein, 5 aa, Artificial Sequence
  Synthetic CDR of PGT antibody
GRFWS

SEQ ID NO: 12 - protein, 6 aa, Artificial Sequence
  Synthetic CDR of PGT antibody
NGSVSG

SEQ ID NO: 13 - protein, 15 aa, Artificial Sequence
  Synthetic CDR of PGT antibody
YHDSGDTNYNPSLKS

SEQ ID NO: 14 - protein, 9 aa, Artificial Sequence
  Synthetic CDR of PGT antibody
YVHDSGDTN

SEQ ID NO: 15 - protein, 16 aa, Artificial Sequence
  Synthetic CDR of PGT antibody
YVHHSGDTNYNPSLKR

SEQ ID NO: 16 - protein, 9 aa, Artificial Sequence
  Synthetic CDR of PGT antibody
YVHHSGDTN

SEQ ID NO: 17 - protein, 16 aa, Artificial Sequence
  Synthetic CDR of PGT antibody
YISDRETTTYNPSLNS

SEQ ID NO: 18 - protein, 9 aa, Artificial Sequence
  Synthetic CDR of PGT antibody
YISDRETTT

SEQ ID NO: 19 - DNA, 693 bp, Artificial Sequence
  synthetic polynucleotide encoding the lambda light chain of PGT-121 LO6
atggcctggacctttctcctcctcggcctcctctctcactgcacagcctctgtgacctccgatatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggatagtagagttcccaccaaatgggtcttcggcggagggaccacgctgaccgtgttaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 20 - DNA, 315 bp, Artificial Sequence
  synthetic polynucleotide encoding the lambda light chain variable region of PGT-121 LO6
tccgatatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggatagtagagttcccaccaaatgggtcttcggcggagggaccacgctgaccgtgtta

SEQ ID NO: 21 - protein, 16 aa, Artificial Sequence
  Synthetic CDR of PGT antibody
YFSDTDRSEYNPSLRS

SEQ ID NO: 22 - protein, 9 aa, Artificial Sequence
  Synthetic CDR of PGT antibody
YFSDTDRSE

SEQ ID NO: 23 - protein, 24 aa, Artificial Sequence
  Synthetic CDR of PGT antibody
TKHGRRIYGVVAFKEWFTYFYMDV

SEQ ID NO: 24 - protein, 24 aa, Artificial Sequence
  Synthetic CDR of PGT antibody
ALHGKRIYGIVALGELFTYFYMDV

SEQ ID NO: 25 - protein, 24 aa, Artificial Sequence
  Synthetic CDR of PGT antibody
ARRGQRIYGVVSFGEFFYYYYMDV

SEQ ID NO: 26 - protein, 24 aa, Artificial Sequence
  Synthetic CDR of PGT antibody
AQQGKRIYGIGSFGEFFYYYYMDA

SEQ ID NO: 27 - protein, 24 aa, Artificial Sequence
  Synthetic CDR of PGT antibody
AQQGKRIYGIVSFGEFFYYYYMDA

SEQ ID NO: 28 - protein, 24 aa, Artificial Sequence
  Synthetic CDR of PGT antibody
AQQGKRIYGIVSFGELFYYYYMDA

SEQ ID NO: 29 - protein, 11 aa, Artificial Sequence
  Synthetic CDR of PGT antibody
GEESLGSRSVI

SEQ ID NO: 30 - protein, 11 aa, Artificial Sequence
  Synthetic CDR of PGT antibody
GKESIGSRAVQ

SEQ ID NO: 31 - protein, 11 aa, Artificial Sequence
  Synthetic CDR of PGT antibody
GRQALGSRAVQ

SEQ ID NO: 32 - protein, 11 aa, Artificial Sequence
  Synthetic CDR of PGT antibody
GERSRGSRAVA

SEQ ID NO: 33 - protein, 11 aa, Artificial Sequence
  Synthetic CDR of PGT antibody
GERSRGSRAVQ

SEQ ID NO: 34 - protein, 7 aa, Artificial Sequence
  Synthetic CDR of PGT antibody
NNNDRPS

SEQ ID NO: 35 - protein, 7 aa, Artificial Sequence
  Synthetic CDR of PGT antibody
NNQDRPA

SEQ ID NO: 36 - protein, 7 aa, Artificial Sequence
  Synthetic CDR of PGT antibody
NNQDRPS

SEQ ID NO: 37 - protein, 12 aa, Artificial Sequence
  Synthetic CDR of PGT antibody
HIWDSRRPTNWV

SEQ ID NO: 38 - protein, 12 aa, Artificial Sequence
  Synthetic CDR of PGT antibody
HIYDARGGTNWV

SEQ ID NO: 39 - protein, 12 aa, Artificial Sequence
  Synthetic CDR of PGT antibody
HMWDSRSGFSWS

SEQ ID NO: 40 - protein, 12 aa, Artificial Sequence
  Synthetic CDR of PGT antibody
HYWDSRSPISWI

SEQ ID NO: 41 - protein, 330 aa, Artificial Sequence
  synthetic IgG1m3 antibody
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 330 aa, Artificial Sequence [sequence omitted]

SEQ ID NO: 43 - protein, 330 aa, Artificial Sequence
  synthetic IgG1m17,1,2 antibody
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 44 - protein, 330 aa, Artificial Sequence
  synthetic IgG1m3,1 antibody
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 45 - protein, 330 aa, Artificial Sequence
  synthetic IgG1m17 antibody
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 462 aa, Artificial Sequence
  Synthetic allotype IgG1m17 antibody
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 47 - protein, 106 aa, Artificial Sequence
  synthetic IgG1 kappa light chain
TVAAPSVFIFPPSDEQLKSGTASVVCLLNNFYPREAKVQWKVDNVLQSGNSQESVTEQDSKDSTYSLSSTLTLSKADYEKHKLYACEVTHQGLSSPVTKSFNRGEC

SEQ ID NO: 48 - protein, 106 aa, Artificial Sequence
  synthetic IgG1 kappa light chain
TVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 49 - protein, 106 aa, Artificial Sequence
  synthetic IgG1 kappa light chain
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 50 - protein, 106 aa, Artificial Sequence
  synthetic IgG1 lambda light chain
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 51 - protein, 106 aa, Artificial Sequence
  synthetic IgG1 lambda light chain
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 52 - protein, 106 aa, Artificial Sequence
  synthetic IgG1 lambda light chain
GQPKAAPSVTLFPPSSEELQANKATLVCLISDFYPGAVTVAWKADSSPAKAGVETTTPSKQSNNKYAASSYLSLTPEQWKSHKSYSCQVTHEGSTVEKTVAPTECS

SEQ ID NO: 53 - protein, 106 aa, Artificial Sequence
  synthetic IgG1 lambda light chain
GQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 54 - protein, 211 aa, Artificial Sequence
  synthetic light chain sequence
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 55 - protein, 105 aa, Artificial Sequence
  synthetic light chain variable region
DISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLG

SEQ ID NO: 56 - protein, 106 aa, Artificial Sequence
  synthetic light chain variable region
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTKLTVLG

SEQ ID NO: 57 - protein, 106 aa, Artificial Sequence
  synthetic light chain variable region
SDISVAPGETARISCGEKSLGSRAVQWYQHRAGQAPSLIIYNNQDRPSGIPERFSGSPDSRPGTTATLTITSVEAGDEADYYCHIWDSRVPTKWVFGGGTTLTVLG

SEQ ID NO: 58 - protein, 107 aa, Artificial Sequence
  synthetic light chain variable region
SDISVAPGETARISCGEKSLGSRAVQWYQHRAGQAPSLIIYNNQDRPSGIPERFSGSPDSRPFGTTATLTITSVEAGDEADYYCHIWDSRVPTKWVFGGGTKLTVLG

SEQ ID NO: 59 - DNA, 5428 bp, Artificial Sequence
  synthetic vector pcDNA3.1
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttggtaccgagctcggatccactagtccagtgtggtggaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 60 - DNA, 24 bp, Artificial Sequence
  synthetic histidine tag coding sequence
caccatcaccatcaccatcaccat

SEQ ID NO: 61 - protein, 138 aa, Mus musculus
MEWSRVFIFLLSVTAGVHSQVQLQQSGAELVRPGTSVKVSCKASGYAFTNYLIEWVKQRPGQGLEWIGVINPGSGGTNYNEKFKGKATLTADKSSSTAYMQLSSLTSEDSAVYFCARSYYGYDWFAYWGQGTLVTVSA

SEQ ID NO: 62 - protein, 120 aa, Mus musculus
MRCLAEFLGLLVLWIPGAIGDIVMTQAAPSVPVTPGESVSISCRSSTSLLHSSGKHRLYWFLQRPGQSPQLLIYYMSNLASGVPDRFSGSGSGTDFTLRISRVEAEDFGVYYCMQSLEYP

SEQ ID NO: 63 - protein, 9 aa, Artificial Sequence
  synthetic T cell epitope sequence
MQLQESGPG

SEQ ID NO: 64 - protein, 9 aa, Artificial Sequence
  synthetic T cell epitope sequence
VQLQESGPG

SEQ ID NO: 65 - protein, 9 aa, Artificial Sequence
  synthetic T cell epitope sequence
VHLQESGPG

SEQ ID NO: 66 - protein, 9 aa, Artificial Sequence
  synthetic T cell epitope sequence
LHLQESGPG

SEQ ID NO: 67 - protein, 9 aa, Artificial Sequence
  synthetic T cell epitope sequence
VSGASISDS

SEQ ID NO: 68 - protein, 9 aa, Artificial Sequence
  synthetic T cell epitope sequence
VSGGSISDS

SEQ ID NO: 69 - protein, 9 aa, Artificial Sequence
  synthetic T cell epitope sequence
VSGASISDA

SEQ ID NO: 70 - protein, 9 aa, Artificial Sequence
  synthetic T cell epitope sequence
VSGGSISDA

SEQ ID NO: 71 - protein, 9 aa, Artificial Sequence
  synthetic T cell epitope sequence
VSGTLVRDN

SEQ ID NO: 72 - protein, 9 aa, Artificial Sequence
  synthetic T cell epitope sequence
VSGASINDA

SEQ ID NO: 73 - protein, 9 aa, Artificial Sequence
  synthetic T cell epitope sequence
VSGGSISNY

SEQ ID NO: 74 - protein, 9 aa, Artificial Sequence
  synthetic T cell epitope sequence
VSNGSVSGR

SEQ ID NO: 75 - protein, 9 aa, Artificial Sequence
  synthetic T cell epitope sequence
IRRSPGKGL

SEQ ID NO: 76 - protein, 9 aa, Artificial Sequence
  synthetic T cell epitope sequence
IRQSPGKGL

SEQ ID NO: 77 - protein, 9 aa, Artificial Sequence
  synthetic T cell epitope sequence
IRQPLGKQP

SEQ ID NO: 78 - protein, 9 aa, Artificial Sequence
  synthetic T cell epitope sequence
IRQSPGKRP

SEQ ID NO: 79 - protein, 9 aa, Artificial Sequence
  synthetic T cell epitope sequence
IRQSPGRGL

SEQ ID NO: 80 - protein, 9 aa, Artificial Sequence
  synthetic T cell epitope sequence
IGYVHKSGD

SEQ ID NO: 81 - protein, 9 aa, Artificial Sequence
  synthetic T cell epitope sequence
IGYVHDSGD

SEQ ID NO: 82 - protein, 9 aa, Artificial Sequence
  synthetic T cell epitope sequence
VGYVHHSGD

SEQ ID NO: 83 - protein, 9 aa, Artificial Sequence
  synthetic T cell epitope sequence
IGYISDRET

SEQ ID NO: 84 - protein, 9 aa, Artificial Sequence
  synthetic T cell epitope sequence
IGYFSDTDR

SEQ ID NO: 85 - protein, 9 aa, Artificial Sequence
  synthetic T cell epitope sequence
LKSRVNLSL

SEQ ID NO: 86 - protein, 9 aa, Artificial Sequence
  synthetic T cell epitope sequence
LKSRVTLSL

SEQ ID NO: 87 - protein, 9 aa, Artificial Sequence
  synthetic T cell epitope sequence
LKSRVHLSL

SEQ ID NO: 88 - protein, 9 aa, Artificial Sequence
  synthetic T cell epitope sequence
LKSRVSLSL

SEQ ID NO: 89 - protein, 9 aa, Artificial Sequence
  synthetic T cell epitope sequence
LKSRVALSL

SEQ ID NO: 90 - protein, 9 aa, Artificial Sequence
  synthetic T cell epitope sequence
LKRRVTFSL

SEQ ID NO: 91 - protein, 9 aa, Artificial Sequence
  synthetic T cell epitope sequence
LNSRAVISR

SEQ ID NO: 92 - protein, 9 aa, Artificial Sequence
  synthetic T cell epitope sequence
LRSRLTLSV

SEQ ID NO: 93 - protein, 9 aa, Artificial Sequence
  synthetic T cell epitope sequence
VSLSLVAAT

SEQ ID NO: 94 - protein, 9 aa, Artificial Sequence
  synthetic T cell epitope sequence
VSLKLVAAT

SEQ ID NO: 95 - protein, 9 aa, Artificial Sequence
  synthetic T cell epitope sequence
VSLSLTSVT

SEQ ID NO: 96 - protein, 9 aa, Artificial Sequence
  synthetic T cell epitope sequence
VSLSLSSVT

SEQ ID NO: 97 - protein, 9 aa, Artificial Sequence
  synthetic T cell epitope sequence
VSLSLKSVT

SEQ ID NO: 98 - protein, 9 aa, Artificial Sequence
  synthetic T cell epitope sequence
VSLSLNSVT

SEQ ID NO: 99 - protein, 9 aa, Artificial Sequence
  synthetic T cell epitope sequence
VSLKLTSVT

SEQ ID NO: 100 - protein, 9 aa, Artificial Sequence
  synthetic T cell epitope sequence
VSLRLTGVT

SEQ ID NO: 101 - protein, 9 aa, Artificial Sequence
  synthetic T cell epitope sequence
VSLKLVDLT

SEQ ID NO: 102 - protein, 9 aa, Artificial Sequence
  synthetic T cell epitope sequence
LSLQLRSVT

SEQ ID NO: 103 - protein, 9 aa, Artificial Sequence
  synthetic T cell epitope sequence
LSLRLKSVT

SEQ ID NO: 104 - protein, 9 aa, Artificial Sequence
  synthetic T cell epitope sequence
LSLKLKSVT

SEQ ID NO: 105 - protein, 9 aa, Artificial Sequence
  synthetic T cell epitope sequence
LVAATAADS

SEQ ID NO: 106 - protein, 9 aa, Artificial Sequence
  synthetic T cell epitope sequence
LTSVTAADS

SEQ ID NO: 107 - protein, 9 aa, Artificial Sequence
  synthetic T cell epitope sequence
LTGVTAADS

SEQ ID NO: 108 - protein, 9 aa, Artificial Sequence
  synthetic T cell epitope sequence
LRSVTAADS

SEQ ID NO: 109 - protein, 9 aa, Artificial Sequence
  synthetic T cell epitope sequence
LKSVTAADS

SEQ ID NO: 110 - protein, 9 aa, Artificial Sequence
  synthetic T cell epitope sequence
LNSVTAADS

SEQ ID NO: 111 - protein, 9 aa, Artificial Sequence
  synthetic T cell epitope sequence
LSSVTAADS

SEQ ID NO: 112 - protein, 9 aa, Artificial Sequence
  synthetic T cell epitope sequence
LVDLTAADS

SEQ ID NO: 113 - protein, 9 aa, Artificial Sequence
  synthetic T cell epitope sequence
LRSVTTADT

SEQ ID NO: 114 - protein, 9 aa, Artificial Sequence
  synthetic T cell epitope sequence
LKSVTAADS

SEQ ID NO: 115 - protein, 9 aa, Artificial Sequence
  synthetic T cell epitope sequence
YYCARTLHG

SEQ ID NO: 116 - protein, 9 aa, Artificial Sequence
  synthetic T cell epitope sequence
YYCATTKHG

SEQ ID NO: 117 - protein, 9 aa, Artificial Sequence
  synthetic T cell epitope sequence
YFCARALHG

SEQ ID NO: 118 - protein, 9 aa, Artificial Sequence
  synthetic T cell epitope sequence
YFCATARRG

SEQ ID NO: 119 - protein, 9 aa, Artificial Sequence
  synthetic T cell epitope sequence
YYCARAQQG

SEQ ID NO: 120 - protein, 9 aa, Artificial Sequence
  synthetic T cell epitope sequence
LHGRRIYGI

SEQ ID NO: 121 - protein, 9 aa, Artificial Sequence
  synthetic T cell epitope sequence
KHGRRIYGV

SEQ ID NO: 122 - protein, 9 aa, Artificial Sequence
  synthetic T cell epitope sequence
LHGKRIYGI

SEQ ID NO: 123 - protein, 9 aa, Artificial Sequence
  synthetic T cell epitope sequence
RRGQRIYGV

SEQ ID NO: 124 - protein, 9 aa, Artificial Sequence
  synthetic T cell epitope sequence
QQGKRIYGI

SEQ ID NO: 125 - protein, 9 aa, Artificial Sequence
  synthetic T cell epitope sequence
IYGIVAFNE

SEQ ID NO: 126 - protein, 9 aa, Artificial Sequence
  synthetic T cell epitope sequence
IYGVVAFKE

SEQ ID NO: 127 - protein, 9 aa, Artificial Sequence
  synthetic T cell epitope sequence
IYGIVALGE

SEQ ID NO: 128 - protein, 9 aa, Artificial Sequence
  synthetic T cell epitope sequence
IYGVVSFGE

SEQ ID NO: 129 - protein, 9 aa, Artificial Sequence
  synthetic T cell epitope sequence
IYGIVSFGE

SEQ ID NO: 130 - protein, 9 aa, Artificial Sequence
  synthetic T cell epitope sequence
YFYMDVWGN

SEQ ID NO: 131 - protein, 9 aa, Artificial Sequence
  synthetic T cell epitope sequence
YFYMDVWGK

SEQ ID NO: 132 - protein, 9 aa, Artificial Sequence
  synthetic T cell epitope sequence
YFYMDVWKQ

SEQ ID NO: 133 - protein, 9 aa, Artificial Sequence
  synthetic T cell epitope sequence
YFYMDVWGA

SEQ ID NO: 134 - protein, 9 aa, Artificial Sequence
  synthetic T cell epitope sequence
YFYMDVWGH

SEQ ID NO: 135 - protein, 9 aa, Artificial Sequence
  synthetic T cell epitope sequence
YFYMDVWGR

SEQ ID NO: 136 - protein, 9 aa, Artificial Sequence
  synthetic T cell epitope sequence
YFYMDVWGT

SEQ ID NO: 137 - protein, 9 aa, Artificial Sequence
  synthetic T cell epitope sequence
YYYMDVWGK

SEQ ID NO: 138 - protein, 9 aa, Artificial Sequence
  synthetic T cell epitope sequence
YYYMDAWGK

SEQ ID NO: 139 - protein, 9 aa, Artificial Sequence
  synthetic T cell epitope sequence
VAPGETARI

SEQ ID NO: 140 - protein, 9 aa, Artificial Sequence
  synthetic T cell epitope sequence
VAPGQTARI

SEQ ID NO: 141 - protein, 9 aa, Artificial Sequence
  synthetic T cell epitope sequence
VSPGETAKI

SEQ ID NO: 142 - protein, 9 aa, Artificial Sequence
  synthetic T cell epitope sequence
VSPLSVALG

SEQ ID NO: 143 - protein, 9 aa, Artificial Sequence
  synthetic T cell epitope sequence
LAPGATAKI

SEQ ID NO: 144 - protein, 9 aa, Artificial Sequence
  synthetic T cell epitope sequence
LIIYNNQDR

SEQ ID NO: 145 - protein, 9 aa, Artificial Sequence
  synthetic T cell epitope sequence
LIIYNNNDR

SEQ ID NO: 146 - protein, 9 aa, Artificial Sequence
  synthetic T cell epitope sequence
LLIYNNQDR

SEQ ID NO: 147 - protein, 9 aa, Artificial Sequence
  synthetic T cell epitope sequence
FGTTATLTI

SEQ ID NO: 148 - protein, 9 aa, Artificial Sequence
  synthetic T cell epitope sequence
PGTTATLTI

SEQ ID NO: 149 - protein, 9 aa, Artificial Sequence
  synthetic T cell epitope sequence
IGVTATLTI

SEQ ID NO: 150 - protein, 9 aa, Artificial Sequence
  synthetic T cell epitope sequence
FGGGTTLTV

SEQ ID NO: 151 - protein, 9 aa, Artificial Sequence
  synthetic T cell epitope sequence
FGEGTTLIV

SEQ ID NO: 152 - protein, 9 aa, Artificial Sequence
  synthetic T cell epitope sequence
FDRGTTLTV

SEQ ID NO: 153 - protein, 9 aa, Artificial Sequence
  synthetic T cell epitope sequence
FGGATRLTV

SEQ ID NO: 154 - protein, 9 aa, Artificial Sequence
  synthetic T cell epitope sequence
FGGGTQLTV

SEQ ID NO: 155 - protein, 9 aa, Artificial Sequence
  synthetic T cell epitope sequence
FAGGTQLTV

SEQ ID NO: 156 - protein, 15 aa, Artificial Sequence
  synthetic T cell epitope sequence
VSGASISDSYWSWIR

SEQ ID NO: 157 - protein, 15 aa, Artificial Sequence
  synthetic T cell epitope sequence
SYWSWIRRSPGKGLE

SEQ ID NO: 158 - protein, 15 aa, Artificial Sequence
  synthetic T cell epitope sequence
QVSLSLVAATAADSG

SEQ ID NO: 159 - protein, 15 aa, Artificial Sequence
  synthetic T cell epitope sequence
QVSLSLTSVTAADSG

SEQ ID NO: 160 - protein, 15 aa, Artificial Sequence
  synthetic T cell epitope sequence
QVSLSLSSVTAADSG

SEQ ID NO: 161 - protein, 15 aa, Artificial Sequence
  synthetic T cell epitope sequence
QVSLSLTGVTAADSG

SEQ ID NO: 162 - protein, 15 aa, Artificial Sequence
  synthetic T cell epitope sequence
IYGIVAFNEWFTYFY

SEQ ID NO: 163 - protein, 15 aa, Artificial Sequence
  synthetic T cell epitope sequence
FNEWFTYFYMDVWGN

SEQ ID NO: 164 - protein, 15 aa, Artificial Sequence
  synthetic T cell epitope sequence
FNEWFTYFYMDVWGK

SEQ ID NO: 165 - protein, 15 aa, Artificial Sequence
  synthetic T cell epitope sequence
FNEWFTYFYMDVWGH

SEQ ID NO: 166 - protein, 15 aa, Artificial Sequence
  synthetic T cell epitope sequence
FNEWFTYFYMDVWGA

SEQ ID NO: 167 - protein, 15 aa, Artificial Sequence
  synthetic T cell epitope sequence
FNEWFTYFYMDVWGT

SEQ ID NO: 168 - protein, 15 aa, Artificial Sequence
  synthetic T cell epitope sequence
WFTYFYMDVWGNGTQ

SEQ ID NO: 169 - protein, 15 aa, Artificial Sequence
  synthetic T cell epitope sequence
WFTYFYMDVWGKGTQ

SEQ ID NO: 170 - protein, 15 aa, Artificial Sequence
  synthetic T cell epitope sequence
WFTYFYMDVWGHGTQ

SEQ ID NO: 171 - protein, 15 aa, Artificial Sequence
  synthetic T cell epitope sequence
WFTYFYMDVWGAGTQ

SEQ ID NO: 172 - protein, 15 aa, Artificial Sequence
  synthetic T cell epitope sequence
WFTYFYMDVWGTGTQ

SEQ ID NO: 173 - protein, 15 aa, Artificial Sequence
  synthetic T cell epitope sequence
YFYMDVWGNGTQVTV

SEQ ID NO: 174 - protein, 15 aa, Artificial Sequence
  synthetic T cell epitope sequence
YFYMDVWGKGTQVTV

SEQ ID NO: 175 - protein, 15 aa, Artificial Sequence
  synthetic T cell epitope sequence
YFYMDVWGHGTQVTV

SEQ ID NO: 176 - protein, 15 aa, Artificial Sequence
  synthetic T cell epitope sequence
YFYMDVWGAGTQVTV

SEQ ID NO: 177 - protein, 15 aa, Artificial Sequence
  synthetic T cell epitope sequence
YFYMDVWGTGTQVTV

SEQ ID NO: 178 - protein, 15 aa, Artificial Sequence
  synthetic T cell epitope sequence
FGTTATLTITSVEAG

SEQ ID NO: 179 - protein, 15 aa, Artificial Sequence
  synthetic T cell epitope sequence
SPFGTTATLTITSVE

SEQ ID NO: 180 - protein, 15 aa, Artificial Sequence
  synthetic T cell epitope sequence
SPDSPFGTTATLTIT

SEQ ID NO: 181 - protein, 15 aa, Artificial Sequence
  synthetic T cell epitope sequence
PTKWVFGGGTTLTVL

SEQ ID NO: 182-189 - skipped (8 entries)

SEQ ID NO: 190 - protein, 462 aa, Artificial Sequence; identical to SEQ ID NO: 46
  Synthetic PG121 heavy chain antibody sequence

SEQ ID NO: 191 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDTLMISRTPEVTCVVVDVEFEDPEVKFNWYVDGVEVHNAKTKPREEQYNSTYRVVSVLTVLHQDWLNGKEYKCKVTNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 192 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 193 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 194 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 195 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFEGGPSVFLFPPKPKDTLMISRTPEVTCVVVAVSHEDPEVKFNWYVDGVEVHNAKTKPREEQYQSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 196 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPRRPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 197 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLLPPKPKDTLMISRTPEVTCVVVDVSHEDPEVKFNWYVDGVEVHNAKTKPPEEQYNSTLRVVSILTVLHQDWLNGKEYKCKVSNKALPAPIEKTISKAKGQPREPQVYTLPPSREEMTKNQVSLTCLVKGFYPSDIAVEWESNGQPENNYKTTPLVLDSDGSFFLYSKLTVDKSRWQQGNVFSCSVMHEALHNHYTQKSLSLSPGK

SEQ ID NO: 198 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDTLMISRTPEVTCVVVDVSFEDPEVKFNWYVDGVEVHNAKTKPREEQYNSTYRVVSVLTVLHQDWLNGKEYKCKVTNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 199 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSFEDPEVKFNWYVDGVEVHNAKTKPREEQYNSTYRVVSVLTVLHQDWLNGKEYKCKVTNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIAATISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 201 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELVGGPSVFLLPPKPKDTLMISRTPEVTCVVVDVSHEDPEVKFNWYVDGVEVHNAKTKPPEEQYNSTLRVVSVLTVLHQDWLNGKEYKCKVSNKALPAPIEKTISKAKGQPREPQVYTLPPSREEMTKNQVSLTCLVKGFYPSDIAVEWESNGQPENNYKTTPLVLDSDGSFFLYSKLTVDKSRWQQGNVFSCSVMHEALHNHYTQKSLSLSPGK

SEQ ID NO: 202 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 203 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 205 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 206 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHGALHNHYTQKSLSLSPGK

SEQ ID NO: 207 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHGALHNHYTQKSLSLSPGK

SEQ ID NO: 208 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHGALHNHYTQKSLSLSPGK

SEQ ID NO: 209 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 210 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 211 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYNPSLKSRVTLSLDTSKNQVSLSLVAATAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 212 - protein, 462 aa, Artificial Sequence
  Synthetic PG121 heavy chain antibody sequence
QMQLQESGPGLVKPSETLSLTCSVSGASISDAYWSWIRRSPGKGLEWIGYVHKSGDTNYNPSLKSRVTLSLDTSKNQVSLSLVAATAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 213 - protein, 462 aa, Artificial Sequence; identical to SEQ ID NO: 211
  Synthetic PG121 heavy chain antibody sequence

SEQ ID NO: 214 - protein, 462 aa, Artificial Sequence; identical to SEQ ID NO: 46
  Synthetic PG121 heavy chain antibody sequence

SEQ ID NO: 215 - protein, 462 aa, Artificial Sequence; identical to SEQ ID NO: 46
  Synthetic PG121 heavy chain antibody sequence

SEQ ID NO: 216 - protein, 462 aa, Artificial Sequence; identical to SEQ ID NO: 46
  Synthetic PG121 heavy chain antibody sequence

SEQ ID NO: 217 - protein, 462 aa, Artificial Sequence; identical to SEQ ID NO: 46
  Synthetic PG121 heavy chain antibody sequence

SEQ ID NO: 218 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 219 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNELFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 221 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEAFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 222 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGTYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 223 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLTSVTAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 224 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLKLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 225 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVHLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 226 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVTLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 227 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYNPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 228 - protein, 462 aa, Artificial Sequence
  Synthetic PG121 heavy chain antibody sequence
QMQLQESGPGLVKPSETLSLTCSVSGASISDSYWSWIRQSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 229 - protein, 462 aa, Artificial Sequence
  Synthetic PG121 heavy chain antibody sequence
QMQLQESGPGLVKPSETLSLTCSVSGASISDAYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 230 - protein, 462 aa, Artificial Sequence
  Synthetic PG121 heavy chain antibody sequence
QMQLQESGPGLVKPSETLSLTCSVSGGSISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 231 - protein, 462 aa, Artificial Sequence
  Synthetic PG121 heavy chain antibody sequence
QVQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 232 - protein, 462 aa, Artificial Sequence
  Synthetic PG121 heavy chain antibody sequence
EMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 233 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGTGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 234 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGHGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 235 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGAGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 236 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVALSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 237 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLTGVTAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLSSVTAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 239 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYAPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 240 - protein, 462 aa, Artificial Sequence; identical to SEQ ID NO: 228
  Synthetic PG121 heavy chain antibody sequence

SEQ ID NO: 241 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLSSVTAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 242 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 243 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLSSVTAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 244 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLSSVTAADSGKYYCARTLHGRRIYGIVAFNEWFTYFYMDVWGHGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 245 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVHLSLDTSKNQVSLSLSSVTAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 246 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVHLSLDTSKNQVSLSLSSVTAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 247 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVHLSLDTSKNQVSLSLSSVTAADSGKYYCARTLHGRRIYGIVAFNEWFTYFYMDVWGHGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 248 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYNPSLKSRVNLSLDTSKNQVSLSLSSVTAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 249 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYNPSLKSRVNLSLDTSKNQVSLSLSSVTAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 250 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYNPSLKSRVNLSLDTSKNQVSLSLSSVTAADSGKYYCARTLHGRRIYGIVAFNEWFTYFYMDVWGHGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 251 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYNPSLKSRVHLSLDTSKNQVSLSLSSVTAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 252 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYNPSLKSRVHLSLDTSKNQVSLSLSSVTAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 253 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYNPSLKSRVHLSLDTSKNQVSLSLSSVTAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFEGGPSVFLFPPKPKDTLMISRTPEVTCVVVAVSHEDPEVKFNWYVDGVEVHNAKTKPREEQYQSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 254 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYNPSLKSRVHLSLDTSKNQVSLSLSSVTAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 255 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYNPSLKSRVHLSLDTSKNQVSLSLSSVTAADSGKYYCARTLHGRRIYGIVAFNEWFTYFYMDVWGHGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 256 - protein, 462 aa, Artificial Sequence
  Synthetic PG121 heavy chain antibody sequence
QMQLQESGPGLVKPSETLSLTCSVSGASISDSYWSWIRQSPGKGLEWIGYVHKSGDTNYSPSLKSRVNLSLDTSKNQVSLSLSSVTAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 257 - protein, 462 aa, Artificial Sequence
  Synthetic PG121 heavy chain antibody sequence
QMQLQESGPGLVKPSETLSLTCSVSGASISDSYWSWIRQSPGKGLEWIGYVHKSGDTNYSPSLKSRVNLSLDTSKNQVSLSLSSVTAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 258 - protein, 462 aa, Artificial Sequence
  Synthetic PG121 heavy chain antibody sequence
QMQLQESGPGLVKPSETLSLTCSVSGASISDSYWSWIRQSPGKGLEWIGYVHKSGDTNYSPSLKSRVNLSLDTSKNQVSLSLSSVTAADSGKYYCARTLHGRRIYGIVAFNEWFTYFYMDVWGHGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 259 - protein, 462 aa, Artificial Sequence
  Synthetic PG121 heavy chain antibody sequence
QMQLQESGPGLVKPSETLSLTCSVSGASISDSYWSWIRQSPGKGLEWIGYVHKSGDTNYSPSLKSRVHLSLDTSKNQVSLSLSSVTAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 260 - protein, 462 aa, Artificial Sequence
  Synthetic PG121 heavy chain antibody sequence
QMQLQESGPGLVKPSETLSLTCSVSGASISDSYWSWIRQSPGKGLEWIGYVHKSGDTNYSPSLKSRVHLSLDTSKNQVSLSLSSVTAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 261 - protein, 462 aa, Artificial Sequence
  Synthetic PG121 heavy chain antibody sequence
QMQLQESGPGLVKPSETLSLTCSVSGASISDSYWSWIRQSPGKGLEWIGYVHKSGDTNYSPSLKSRVHLSLDTSKNQVSLSLSSVTAADSGKYYCARTLHGRRIYGIVAFNEWFTYFYMDVWGHGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 262 - protein, 462 aa, Artificial Sequence
  Synthetic PG121 heavy chain antibody sequence
QMQLQESGPGLVKPSETLSLTCSVSGASISDSYWSWIRQSPGKGLEWIGYVHKSGDTNYNPSLKSRVNLSLDTSKNQVSLSLSSVTAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 263 - protein, 462 aa, Artificial Sequence
  Synthetic PG121 heavy chain antibody sequence
QMQLQESGPGLVKPSETLSLTCSVSGASISDSYWSWIRQSPGKGLEWIGYVHKSGDTNYNPSLKSRVNLSLDTSKNQVSLSLSSVTAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 264 - protein, 462 aa, Artificial Sequence
  Synthetic PG121 heavy chain antibody sequence
QMQLQESGPGLVKPSETLSLTCSVSGASISDSYWSWIRQSPGKGLEWIGYVHKSGDTNYNPSLKSRVNLSLDTSKNQVSLSLSSVTAADSGKYYCARTLHGRRIYGIVAFNEWFTYFYMDVWGHGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 265 - protein, 462 aa, Artificial Sequence
  Synthetic PG121 heavy chain antibody sequence
QMQLQESGPGLVKPSETLSLTCSVSGASISDSYWSWIRQSPGKGLEWIGYVHKSGDTNYNPSLKSRVHLSLDTSKNQVSLSLSSVTAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 266 - protein, 462 aa, Artificial Sequence
  Synthetic PG121 heavy chain antibody sequence
QMQLQESGPGLVKPSETLSLTCSVSGASISDSYWSWIRQSPGKGLEWIGYVHKSGDTNYNPSLKSRVHLSLDTSKNQVSLSLSSVTAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 267 - protein, 462 aa, Artificial Sequence
  Synthetic PG121 heavy chain antibody sequence
QMQLQESGPGLVKPSETLSLTCSVSGASISDSYWSWIRQSPGKGLEWIGYVHKSGDTNYNPSLKSRVHLSLDTSKNQVSLSLSSVTAADSGKYYCARTLHGRRIYGIVAFNEWFTYFYMDVWGHGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 268 - protein, 462 aa, Artificial Sequence
  Synthetic PG121 heavy chain antibody sequence
QLQLQESGPGLVKPSETLSLTCSVSGASISDAYWSWIRRSPGKGLEWIGYVHKSGDTNYNPSLKSRVHLSLDTSKNQVSLSLTGVTAADSGKYYCARALHGRRIYGIVAFNEWFTYFYMDVWGTGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 269 - protein, 462 aa, Artificial Sequence; identical to SEQ ID NO: 268
  Synthetic PG121 heavy chain antibody sequence

SEQ ID NO: 270 - protein, 462 aa, Artificial Sequence; identical to SEQ ID NO: 268
  Synthetic PG121 heavy chain antibody sequence

SEQ ID NO: 271 - protein, 462 aa, Artificial Sequence; identical to SEQ ID NO: 268
  Synthetic PG121 heavy chain antibody sequence

SEQ ID NO: 272 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYNPSLKSRVHLSLDTSKNQVSLSLTGVTAADSGKYYCARTLHGRRIYGIVAFNEWFTYFYMDVWGTGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 273 - protein, 462 aa, Artificial Sequence; identical to SEQ ID NO: 272
  Synthetic PG121 heavy chain antibody sequence

SEQ ID NO: 274 - protein, 462 aa, Artificial Sequence; identical to SEQ ID NO: 272
  Synthetic PG121 heavy chain antibody sequence

SEQ ID NO: 275 - protein, 462 aa, Artificial Sequence; identical to SEQ ID NO: 272
  Synthetic PG121 heavy chain antibody sequence

SEQ ID NO: 276 - protein, 211 aa, Artificial Sequence; identical to SEQ ID NO: 54
  Synthetic PG121 light chain antibody sequence

SEQ ID NO: 277 - protein, 211 aa, Artificial Sequence; identical to SEQ ID NO: 54
  Synthetic PG121 light chain antibody sequence

SEQ ID NO: 278 - protein, 211 aa, Artificial Sequence; identical to SEQ ID NO: 54
  Synthetic PG121 light chain antibody sequence

SEQ ID NO: 279 - protein, 211 aa, Artificial Sequence; identical to SEQ ID NO: 54
  Synthetic PG121 light chain antibody sequence

SEQ ID NO: 280 - protein, 211 aa, Artificial Sequence; identical to SEQ ID NO: 54
  Synthetic PG121 light chain antibody sequence

SEQ ID NO: 281 - protein, 211 aa, Artificial Sequence; identical to SEQ ID NO: 54
  Synthetic PG121 light chain antibody sequence

SEQ ID NO: 282 - protein, 211 aa, Artificial Sequence; identical to SEQ ID NO: 54
  Synthetic PG121 light chain antibody sequence

SEQ ID NO: 283 - protein, 211 aa, Artificial Sequence; identical to SEQ ID NO: 54
  Synthetic PG121 light chain antibody sequence

SEQ ID NO: 284 - protein, 211 aa, Artificial Sequence; identical to SEQ ID NO: 54
  Synthetic PG121 light chain antibody sequence

SEQ ID NO: 285 - protein, 211 aa, Artificial Sequence; identical to SEQ ID NO: 54
  Synthetic PG121 light chain antibody sequence

SEQ ID NO: 286 - protein, 211 aa, Artificial Sequence; identical to SEQ ID NO: 54
  Synthetic PG121 light chain antibody sequence

SEQ ID NO: 287 - protein, 211 aa, Artificial Sequence; identical to SEQ ID NO: 54
  Synthetic PG121 light chain antibody sequence

SEQ ID NO: 288 - protein, 211 aa, Artificial Sequence; identical to SEQ ID NO: 54
  Synthetic PG121 light chain antibody sequence

SEQ ID NO: 289 - protein, 211 aa, Artificial Sequence; identical to SEQ ID NO: 54
  Synthetic PG121 light chain antibody sequence

SEQ ID NO: 290 - protein, 211 aa, Artificial Sequence; identical to SEQ ID NO: 54
  Synthetic PG121 light chain antibody sequence

SEQ ID NO: 291 - protein, 211 aa, Artificial Sequence; identical to SEQ ID NO: 54
  Synthetic PG121 light chain antibody sequence

SEQ ID NO: 292 - protein, 211 aa, Artificial Sequence; identical to SEQ ID NO: 54
  Synthetic PG121 light chain antibody sequence

SEQ ID NO: 293 - protein, 211 aa, Artificial Sequence; identical to SEQ ID NO: 54
  Synthetic PG121 light chain antibody sequence

SEQ ID NO: 294 - protein, 211 aa, Artificial Sequence; identical to SEQ ID NO: 54
  Synthetic PG121 light chain antibody sequence

SEQ ID NO: 295 - protein, 211 aa, Artificial Sequence; identical to SEQ ID NO: 54
  Synthetic PG121 light chain antibody sequence

SEQ ID NO: 296 - protein, 211 aa, Artificial Sequence; identical to SEQ ID NO: 54
  Synthetic PG121 light chain antibody sequence

SEQ ID NO: 297 - protein, 218 aa, Artificial Sequence
  Synthetic PG121 light chain antibody sequence
SYVLTQPSDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 298 - protein, 211 aa, Artificial Sequence; identical to SEQ ID NO: 54
  Synthetic PG121 light chain antibody sequence

SEQ ID NO: 299 - protein, 211 aa, Artificial Sequence; identical to SEQ ID NO: 54
  Synthetic PG121 light chain antibody sequence

SEQ ID NO: 300 - protein, 211 aa, Artificial Sequence
  Synthetic PG121 light chain antibody sequence
SDISVAPGETARISCGEKSLGSRAVQWYQHRAGQAPSLIIYNNQDRPSGIPERFSGSPDSPFGTTATLTITSVEAGDEADYYCHIWDSRVPTNWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 301 - protein, 211 aa, Artificial Sequence
  Synthetic PG121 light chain antibody sequence
SDISVAPGETARISCGEKSLGSRAVQWYQHRAGQAPTLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 302 - protein, 218 aa, Artificial Sequence
  Synthetic PG121 light chain antibody sequence
SSVTSYVSDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 303 - protein, 218 aa, Artificial Sequence; identical to SEQ ID NO: 297
  Synthetic PG121 light chain antibody sequence

SEQ ID NO: 304 - protein, 211 aa, Artificial Sequence; identical to SEQ ID NO: 54
  Synthetic PG121 light chain antibody sequence

SEQ ID NO: 305 - protein, 211 aa, Artificial Sequence; identical to SEQ ID NO: 54
  Synthetic PG121 light chain antibody sequence

SEQ ID NO: 306 - protein, 211 aa, Artificial Sequence; identical to SEQ ID NO: 54
  Synthetic PG121 light chain antibody sequence

SEQ ID NO: 307 - protein, 211 aa, Artificial Sequence; identical to SEQ ID NO: 54
  Synthetic PG121 light chain antibody sequence

SEQ ID NO: 308 - protein, 211 aa, Artificial Sequence; identical to SEQ ID NO: 54
  Synthetic PG121 light chain antibody sequence

SEQ ID NO: 309 - protein, 211 aa, Artificial Sequence; identical to SEQ ID NO: 54
  Synthetic PG121 light chain antibody sequence

SEQ ID NO: 310 - protein, 211 aa, Artificial Sequence; identical to SEQ ID NO: 54
  Synthetic PG121 light chain antibody sequence

SEQ ID NO: 311 - protein, 211 aa, Artificial Sequence; identical to SEQ ID NO: 54
  Synthetic PG121 light chain antibody sequence

SEQ ID NO: 312 - protein, 211 aa, Artificial Sequence; identical to SEQ ID NO: 54
  Synthetic PG121 light chain antibody sequence

SEQ ID NO: 313 - protein, 211 aa, Artificial Sequence; identical to SEQ ID NO: 54
  Synthetic PG121 light chain antibody sequence

SEQ ID NO: 314 - protein, 211 aa, Artificial Sequence
  Synthetic PG121 light chain antibody sequence
SDISVAPGETARISCGEKSLGSRAVQWYQQRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 315 - protein, 211 aa, Artificial Sequence; identical to SEQ ID NO: 54
  Synthetic PG121 light chain antibody sequence

SEQ ID NO: 316 - protein, 211 aa, Artificial Sequence; identical to SEQ ID NO: 54
  Synthetic PG121 light chain antibody sequence

SEQ ID NO: 317 - protein, 211 aa, Artificial Sequence; identical to SEQ ID NO: 54
  Synthetic PG121 light chain antibody sequence

SEQ ID NO: 318 - protein, 211 aa, Artificial Sequence; identical to SEQ ID NO: 54
  Synthetic PG121 light chain antibody sequence

SEQ ID NO: 319 - protein, 211 aa, Artificial Sequence; identical to SEQ ID NO: 54
  Synthetic PG121 light chain antibody sequence

SEQ ID NO: 320 - protein, 211 aa, Artificial Sequence; identical to SEQ ID NO: 54
  Synthetic PG121 light chain antibody sequence

SEQ ID NO: 321 - protein, 211 aa, Artificial Sequence; identical to SEQ ID NO: 54
  Synthetic PG121 light chain antibody sequence

SEQ ID NO: 322 - protein, 211 aa, Artificial Sequence; identical to SEQ ID NO: 54
  Synthetic PG121 light chain antibody sequence

SEQ ID NO: 323 - protein, 211 aa, Artificial Sequence; identical to SEQ ID NO: 54
  Synthetic PG121 light chain antibody sequence

SEQ ID NO: 324 - protein, 211 aa, Artificial Sequence; identical to SEQ ID NO: 54
  Synthetic PG121 light chain antibody sequence

SEQ ID NO: 325 - protein, 211 aa, Artificial Sequence; identical to SEQ ID NO: 54
  Synthetic PG121 light chain antibody sequence

SEQ ID NO: 326 - protein, 211 aa, Artificial Sequence; identical to SEQ ID NO: 54
  Synthetic PG121 light chain antibody sequence

SEQ ID NO: 327 - protein, 211 aa, Artificial Sequence; identical to SEQ ID NO: 54
  Synthetic PG121 light chain antibody sequence

SEQ ID NO: 328 - protein, 211 aa, Artificial Sequence; identical to SEQ ID NO: 54
  Synthetic PG121 light chain antibody sequence

SEQ ID NO: 329 - protein, 211 aa, Artificial Sequence; identical to SEQ ID NO: 54
  Synthetic PG121 light chain antibody sequence

SEQ ID NO: 330 - protein, 211 aa, Artificial Sequence; identical to SEQ ID NO: 54
  Synthetic PG121 light chain antibody sequence

SEQ ID NO: 331 - protein, 211 aa, Artificial Sequence; identical to SEQ ID NO: 54
  Synthetic PG121 light chain antibody sequence

SEQ ID NO: 332 - protein, 211 aa, Artificial Sequence; identical to SEQ ID NO: 54
  Synthetic PG121 light chain antibody sequence

SEQ ID NO: 333 - protein, 211 aa, Artificial Sequence; identical to SEQ ID NO: 54
  Synthetic PG121 light chain antibody sequence

SEQ ID NO: 334 - protein, 211 aa, Artificial Sequence; identical to SEQ ID NO: 54
  Synthetic PG121 light chain antibody sequence

SEQ ID NO: 335 - protein, 211 aa, Artificial Sequence; identical to SEQ ID NO: 54
  Synthetic PG121 light chain antibody sequence

SEQ ID NO: 336 - protein, 211 aa, Artificial Sequence; identical to SEQ ID NO: 54
  Synthetic PG121 light chain antibody sequence

SEQ ID NO: 337 - protein, 211 aa, Artificial Sequence; identical to SEQ ID NO: 54
  Synthetic PG121 light chain antibody sequence

SEQ ID NO: 338 - protein, 211 aa, Artificial Sequence; identical to SEQ ID NO: 54
  Synthetic PG121 light chain antibody sequence

SEQ ID NO: 339 - protein, 211 aa, Artificial Sequence; identical to SEQ ID NO: 54
  Synthetic PG121 light chain antibody sequence

SEQ ID NO: 340 - protein, 211 aa, Artificial Sequence; identical to SEQ ID NO: 54
  Synthetic PG121 light chain antibody sequence

SEQ ID NO: 341 - protein, 211 aa, Artificial Sequence; identical to SEQ ID NO: 54
  Synthetic PG121 light chain antibody sequence

SEQ ID NO: 342 - protein, 211 aa, Artificial Sequence; identical to SEQ ID NO: 54
  Synthetic PG121 light chain antibody sequence

SEQ ID NO: 343 - protein, 211 aa, Artificial Sequence; identical to SEQ ID NO: 54
  Synthetic PG121 light chain antibody sequence

SEQ ID NO: 344 - protein, 211 aa, Artificial Sequence; identical to SEQ ID NO: 54
  Synthetic PG121 light chain antibody sequence

SEQ ID NO: 345 - protein, 211 aa, Artificial Sequence; identical to SEQ ID NO: 54
  Synthetic PG121 light chain antibody sequence

SEQ ID NO: 346 - protein, 211 aa, Artificial Sequence; identical to SEQ ID NO: 54
  Synthetic PG121 light chain antibody sequence

SEQ ID NO: 347 - protein, 211 aa, Artificial Sequence; identical to SEQ ID NO: 54
  Synthetic PG121 light chain antibody sequence

SEQ ID NO: 348 - protein, 211 aa, Artificial Sequence; identical to SEQ ID NO: 54
  Synthetic PG121 light chain antibody sequence

SEQ ID NO: 349 - protein, 211 aa, Artificial Sequence; identical to SEQ ID NO: 54
  Synthetic PG121 light chain antibody sequence

SEQ ID NO: 350 - protein, 211 aa, Artificial Sequence; identical to SEQ ID NO: 54
  Synthetic PG121 light chain antibody sequence

SEQ ID NO: 351 - protein, 211 aa, Artificial Sequence; identical to SEQ ID NO: 54
  Synthetic PG121 light chain antibody sequence

SEQ ID NO: 352 - protein, 211 aa, Artificial Sequence; identical to SEQ ID NO: 54
  Synthetic PG121 light chain antibody sequence

SEQ ID NO: 353 - protein, 211 aa, Artificial Sequence; identical to SEQ ID NO: 54
  Synthetic PG121 light chain antibody sequence

SEQ ID NO: 354 - protein, 211 aa, Artificial Sequence
  Synthetic PG121 light chain antibody sequence
SDISVAPGETARISCGEKSLGSRAVQWYQHRAGQAPSLIIYNNQDRPSGIPERFSGSPDSRPGTTATLTITSVEAGDEADYYCHIWDSRVPTKWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 355 - protein, 211 aa, Artificial Sequence
  Synthetic PG121 light chain antibody sequence
SDISVAPGETARISCGEKSLGSRAVQWYQHRAGQAPSLIIYNNQDRPSGIPERFSGSPDSRPGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 356 - protein, 211 aa, Artificial Sequence
  Synthetic PG121 light chain antibody sequence
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 357 - protein, 211 aa, Artificial Sequence; identical to SEQ ID NO: 54
  Synthetic PG121 light chain antibody sequence

SEQ ID NO: 358 - protein, 211 aa, Artificial Sequence; identical to SEQ ID NO: 354
  Synthetic PG121 light chain antibody sequence

SEQ ID NO: 359 - protein, 211 aa, Artificial Sequence; identical to SEQ ID NO: 355
  Synthetic PG121 light chain antibody sequence

SEQ ID NO: 360 - protein, 211 aa, Artificial Sequence; identical to SEQ ID NO: 356
  Synthetic PG121 light chain antibody sequence

SEQ ID NO: 361 - protein, 211 aa, Artificial Sequence; identical to SEQ ID NO: 54
  Synthetic PG121 light chain antibody sequence

SEQ ID NO: 362 - protein, 5 aa, Artificial Sequence
  Synthetic PG121 heavy CDR1 (kabat) sequence
DSYWS

SEQ ID NO: 363 - protein, 5 aa, Artificial Sequence
  Synthetic PG121 heavy CDR1 (kabat) sequence
DAYWS

SEQ ID NO: 364 - protein, 16 aa, Artificial Sequence
  Synthetic PG121 heavy CDR2 (kabat) sequence
YVHKSGDTNYSPSLKS

SEQ ID NO: 365 - protein, 16 aa, Artificial Sequence
  Synthetic PG121 heavy CDR2 (kabat) sequence
YVHKSGDTNYAPSLKS

SEQ ID NO: 366 - protein, 16 aa, Artificial Sequence
  Synthetic PG121 heavy CDR2 (kabat) sequence
YVHKSGDTNYNPSLKS

SEQ ID NO: 367 - protein, 24 aa, Artificial Sequence
  Synthetic PG121 heavy CDR3 (kabat) sequence
TLHGRRIYGIVAFNEWFTYFYMDV

SEQ ID NO: 368 - protein, 24 aa, Artificial Sequence
  Synthetic PG121 heavy CDR3 (kabat) sequence
ALHGRRIYGIVAFNEWFTYFYMDV

SEQ ID NO: 369 - protein, 24 aa, Artificial Sequence
  Synthetic PG121 heavy CDR3 (kabat) sequence
TLHGRRIYGIVAFNEAFTYFYMDV

SEQ ID NO: 370 - protein, 24 aa, Artificial Sequence
  Synthetic PG121 heavy CDR3 (kabat) sequence
TLHGRRIYGIVAFNELFTYFYMDV

SEQ ID NO: 371 - protein, 8 aa, Artificial Sequence
  Synthetic PG121 heavy CDR1 (IMGT) sequence
GASISDSY

SEQ ID NO: 372 - protein, 8 aa, Artificial Sequence
  Synthetic PG121 heavy CDR1 (IMGT) sequence
GASISDAY

SEQ ID NO: 373 - protein, 8 aa, Artificial Sequence
  Synthetic PG121 heavy CDR1 (IMGT) sequence
GGSISDSY

SEQ ID NO: 374 - protein, 7 aa, Artificial Sequence
  Synthetic PG121 heavy CDR2 (IMGT) sequence
VHKSGDT

SEQ ID NO: 375 - protein, 26 aa, Artificial Sequence
  Synthetic PG121 heavy CDR3 (IMGT) sequence
ARTLHGRRIYGIVAFNEWFTYFYMDV

SEQ ID NO: 376 - protein, 26 aa, Artificial Sequence
  Synthetic PG121 heavy CDR3 (IMGT) sequence
ARALHGRRIYGIVAFNEWFTYFYMDV

SEQ ID NO: 377 - protein, 26 aa, Artificial Sequence
  Synthetic PG121 heavy CDR3 (IMGT) sequence
ARTLHGRRIYGIVAFNEAFTYFYMDV

SEQ ID NO: 378 - protein, 26 aa, Artificial Sequence
  Synthetic PG121 heavy CDR3 (IMGT) sequence
ARTLHGRRIYGIVAFNELFTYFYMDV

SEQ ID NO: 379 - protein, 7 aa, Artificial Sequence
  Synthetic PG121 heavy CDR1 (Clothia) sequence
GASISDS

SEQ ID NO: 380 - protein, 7 aa, Artificial Sequence
  Synthetic PG121 heavy CDR1 (Clothia) sequence
GASISDA

SEQ ID NO: 381 - protein, 7 aa, Artificial Sequence
  Synthetic PG121 heavy CDR1 (Clothia) sequence
GGSISDS

SEQ ID NO: 382 - protein, 22 aa, Artificial Sequence
  Synthetic PG121 heavy CDR3 (Clothia) sequence
LHGRRIYGIVAFNEWFTYFYMD

SEQ ID NO: 383 - protein, 22 aa, Artificial Sequence
  Synthetic PG121 heavy CDR3 (Clothia) sequence
LHGRRIYGIVAFNEAFTYFYMD

SEQ ID NO: 384 - protein, 22 aa, Artificial Sequence
  Synthetic PG121 heavy CDR3 (Clothia) sequence
LHGRRIYGIVAFNELFTYFYMD

SEQ ID NO: 385 - protein, 10 aa, Artificial Sequence
  Synthetic PG121 heavy CDR1 (Honegger) sequence
VSGASISDSY

SEQ ID NO: 386 - protein, 10 aa, Artificial Sequence
  Synthetic PG121 heavy CDR1 (Honegger) sequence
VSGASISDAY

SEQ ID NO: 387 - protein, 10 aa, Artificial Sequence
  Synthetic PG121 heavy CDR1 (Honegger) sequence
VSGGSISDSY

SEQ ID NO: 388 - protein, 16 aa, Artificial Sequence
  Synthetic PG121 heavy CDR2 (Honegger) sequence
VHKSGDTNYSPSLKSR

SEQ ID NO: 389 - protein, 16 aa, Artificial Sequence
  Synthetic PG121 heavy CDR2 (Honegger) sequence
VHKSGDTNYAPSLKSR

SEQ ID NO: 390 - protein, 16 aa, Artificial Sequence
  Synthetic PG121 heavy CDR2 (Honegger) sequence
VHKSGDTNYNPSLKSR

SEQ ID NO: 391 - protein, 23 aa, Artificial Sequence
  Synthetic PG121 heavy CDR3 (Honegger) sequence
TLHGRRIYGIVAFNEWFTYFYMD

SEQ ID NO: 392 - protein, 23 aa, Artificial Sequence
  Synthetic PG121 heavy CDR3 (Honegger) sequence
ALHGRRIYGIVAFNEWFTYFYMD

SEQ ID NO: 393 - protein, 23 aa, Artificial Sequence
  Synthetic PG121 heavy CDR3 (Honegger) sequence
TLHGRRIYGIVAFNEAFTYFYMD

SEQ ID NO: 394 - protein, 23 aa, Artificial Sequence
  Synthetic PG121 heavy CDR3 (Honegger) sequence
TLHGRRIYGIVAFNELFTYFYMD

SEQ ID NO: 395 - protein, 11 aa, Artificial Sequence
  Synthetic PG121light CDR1 (Kabat) sequence
GEKSLGSRAVQ

SEQ ID NO: 396 - protein, 7 aa, Artificial Sequence
  Synthetic PG121light CDR2 (Kabat) sequence
NNQDRPS

SEQ ID NO: 397 - protein, 12 aa, Artificial Sequence
  Synthetic PG121light CDR3 (Kabat, IMGT) sequence
HIWDSRVPTKWV

SEQ ID NO: 398 - protein, 12 aa, Artificial Sequence
  Synthetic PG121light CDR3 (Kabat, IMGT) sequence
HIWDSRVPTNWV

SEQ ID NO: 399 - protein, 6 aa, Artificial Sequence
  Synthetic PG121light CDR1 (IMGT) sequence
SLGSRA

SEQ ID NO: 400 - protein, 8 aa, Artificial Sequence
  Synthetic PG121light CDR1 (Clothia, Honegger) sequence
EKSLGSRA

SEQ ID NO: 401 - protein, 9 aa, Artificial Sequence
  Synthetic PG121light CDR3 (Clothia, Honegger) sequence
WDSRVPTKW

SEQ ID NO: 402 - protein, 9 aa, Artificial Sequence
  Synthetic PG121light CDR3 (Clothia, Honegger) sequence
WDSRVPTNW

SEQ ID NO: 403 - protein, 12 aa, Artificial Sequence
  Synthetic PG121light CDR2 (Honegger) sequence
NNQDRPSGIPER

SEQ ID NO: 404 - protein, 462 aa, Artificial Sequence
  Synthetic PG123 heavy chain antibody sequence
QLHLQESGPGLVKPPETLSLTCSVSGASINDAYWSWIRQSPGKRPEWVGYVHHSGDTNYNPSLKRRVTFSLDTAKNEVSLKLVDLTAADSATYFCARALHGKRIYGIVALGELFTYFYMDVWGKGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 405 - protein, 16 aa, Artificial Sequence
  Synthetic PG123 heavy CDR2 (Kabat) sequence
YVHKSGDTNYNPSLKS

SEQ ID NO: 406 - protein, 24 aa, Artificial Sequence
  Synthetic PG123 heavy CDR3 (Kabat) sequence
ALHGKRIYGIVALGELFTYFYMDV

SEQ ID NO: 407 - protein, 8 aa, Artificial Sequence
  Synthetic PG123 heavy CDR1 (IMGT) sequence
GASINDAY

SEQ ID NO: 408 - protein, 7 aa, Artificial Sequence
  Synthetic PG123 heavy CDR2 (IMGT) sequence
VHHSGDT

SEQ ID NO: 409 - protein, 26 aa, Artificial Sequence
  Synthetic PG123 heavy CDR3 (IMGT) sequence
ARALHGKRIYGIVALGELFTYFYMDV

SEQ ID NO: 410 - protein, 7 aa, Artificial Sequence
  Synthetic PG123 heavy CDR1 (Clothia) sequence
GASINDA

SEQ ID NO: 411 - protein, 22 aa, Artificial Sequence
  Synthetic PG123 heavy CDR3 (Clothia) sequence
LHGKRIYGIVALGELFTYFYMD

SEQ ID NO: 412 - protein, 10 aa, Artificial Sequence
  Synthetic PG123 heavy CDR1 (Honegger) sequence
VSGASINDAY

SEQ ID NO: 413 - protein, 16 aa, Artificial Sequence
  Synthetic PG123 heavy CDR2 (Honegger) sequence
VHHSGDTNYNPSLKRR

SEQ ID NO: 414 - protein, 23 aa, Artificial Sequence
  Synthetic PG123 heavy CDR3 (Honegger) sequence
ALHGKRIYGIVALGELFTYFYMD

SEQ ID NO: 415 - protein, 211 aa, Artificial Sequence
  Synthetic PG123 light chain antibody sequence
SSMSVSPGETAKISCGKESIGSRAVQWYQQKPGQPPSLIIYNNQDRPAGVPERFSASPDFRPGTTATLTITNVDAEDEADYYCHIYDARGGTNWVFDRGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 416 - protein, 11 aa, Artificial Sequence
  Synthetic PG123light CDR1 (Kabat) sequence
GKESIGSRAVQ

SEQ ID NO: 417 - protein, 7 aa, Artificial Sequence
  Synthetic PG123light CDR2 (Kabat) sequence
NNQDRPA

SEQ ID NO: 418 - protein, 12 aa, Artificial Sequence
  Synthetic PG123light CDR3 (Kabat, IMGT) sequence
HIYDARGGTNWV

SEQ ID NO: 419 - protein, 6 aa, Artificial Sequence
  Synthetic PG123light CDR1 (IMGT) sequence
SIGSRA

SEQ ID NO: 420 - protein, 8 aa, Artificial Sequence
  Synthetic PG123light CDR1 (Clothia, Honegger) sequence
KESIGSRA

SEQ ID NO: 421 - protein, 9 aa, Artificial Sequence
  Synthetic PG123 light CDR3 (Clothia, Honegger) sequence
YDARGGTNW

SEQ ID NO: 422 - protein, 12 aa, Artificial Sequence
  Synthetic PG123 light CDR2 (Honegger) sequence
NNQDRPAGVPER

SEQ ID NO: 423 - protein, 481 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGLNDIFEAQKIEWHE

SEQ ID NO: 424 - protein, 211 aa, Artificial Sequence; identical to SEQ ID NO: 54
  Synthetic PG121 light chain antibody sequence

SEQ ID NO: 425 - protein, 481 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYNPSLKSRVHLSLDTSKNQVSLSLSSVTAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGKGGSGGLNDIFEAQKIEWHE

SEQ ID NO: 426 - protein, 211 aa, Artificial Sequence; identical to SEQ ID NO: 54
  Synthetic PG121 light chain antibody sequence

SEQ ID NO: 427 - protein, 462 aa, Artificial Sequence
  Synthetic PG123 heavy chain antibody sequence
QLHLQESGPGLVKPPETLSLTCSVSGASINDAYWSWIRQSPGKRPEWVGYVHHSGDTNYNPSLKRRVTFSLDTAKNEVSLKLVDLTAADSATYFCARALHGKRIYGIVALGELFTYFYMDVWGKGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 428 - protein, 211 aa, Artificial Sequence
  Synthetic PG123 light chain antibody sequence
SSMSVSPGETAKISCGKESIGSRAVQWYQQKPGQPPSLIIYNNQDRPAGVPERFSASPDFRPGTTATLTITNVDAEDEADYYCHIYDARGGTNWVFDRGTTLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 429 - protein, 462 aa, Artificial Sequence
  Synthetic PG122 heavy chain antibody sequence
QVHLQESGPGLVKPSETLSLTCNVSGTLVRDNYWSWIRQPLGKQPEWIGYVHDSGDTNYNPSLKSRVHLSLDKSKNLVSLRLTGVTAADSAIYYCATTKHGRRIYGVVAFKEWFTYFYMDVWGKGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 430 - protein, 211 aa, Artificial Sequence
  Synthetic PG122 light chain antibody sequence
TFVSVAPGQTARITCGEESLGSRSVIWYQQRPGQAPSLIIYNNNDRPSGIPDRFSGSPGSTFGTTATLTITSVEAGDEADYYCHIWDSRRPTNWVFGEGTTLIVLSQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 431 - protein, 5 aa, Artificial Sequence
  Synthetic PG122 heavy CDR1 (Kabat) sequence
DNYWS

SEQ ID NO: 432 - protein, 16 aa, Artificial Sequence
  Synthetic PG122 heavy CDR2 (Kabat) sequence
YVHDSGDTNYNPSLKS

SEQ ID NO: 433 - protein, 24 aa, Artificial Sequence
  Synthetic PG122 heavy CDR3 (Kabat) sequence
TKHGRRIYGVVAFKEWFTYFYMDV

SEQ ID NO: 434 - protein, 8 aa, Artificial Sequence
  Synthetic PG122 heavy CDR1 (IMGT) sequence
GTLVRDNY

SEQ ID NO: 435 - protein, 7 aa, Artificial Sequence
  Synthetic PG122 heavy CDR2 (IMGT) sequence
VHDSGDT

SEQ ID NO: 436 - protein, 26 aa, Artificial Sequence
  Synthetic PG122 heavy CDR3 (IMGT) sequence
ATTKHGRRIYGVVAFKEWFTYFYMDV

SEQ ID NO: 437 - protein, 7 aa, Artificial Sequence
  Synthetic PG122 heavy CDR1 (Clothia) sequence
GTLVRDN

SEQ ID NO: 438 - protein, 22 aa, Artificial Sequence
  Synthetic PG122 heavy CDR3 (Clothia) sequence
KHGRRIYGVVAFKEWFTYFYMD

SEQ ID NO: 439 - protein, 10 aa, Artificial Sequence
  Synthetic PG122 heavy CDR1 (Honegger) sequence
VSGTLVRDNY

SEQ ID NO: 440 - protein, 16 aa, Artificial Sequence
  Synthetic PG122 heavy CDR2 (Honegger) sequence
VHDSGDTNYNPSLKSR

SEQ ID NO: 441 - protein, 23 aa, Artificial Sequence
  Synthetic PG122 heavy CDR3 (Honegger) sequence
TKHGRRIYGVVAFKEWFTYFYMD

SEQ ID NO: 442 - protein, 11 aa, Artificial Sequence
  Synthetic PG122 light CDR1 (Kabat) sequence
GEESLGSRSVI

SEQ ID NO: 443 - protein, 7 aa, Artificial Sequence
  Synthetic PG122 light CDR2 (Kabat) sequence
NNNDRPS

SEQ ID NO: 444 - protein, 12 aa, Artificial Sequence
  Synthetic PG122 light CDR3 (Kabat, IMGT) sequence
HIWDSRRPTNWV

SEQ ID NO: 445 - protein, 6 aa, Artificial Sequence
  Synthetic PG122 light CDR1 (IMGT) sequence
SLGSRS

SEQ ID NO: 446 - protein, 8 aa, Artificial Sequence
  Synthetic PG122 light CDR1 (Clothia, Honegger) sequence
EESLGSRS

SEQ ID NO: 447 - protein, 9 aa, Artificial Sequence
  Synthetic PG122 light CDR3 (Clothia, Honegger) sequence
WDSRRPTNW

SEQ ID NO: 448 - protein, 12 aa, Artificial Sequence
  Synthetic PG122 light CDR2 (Honegger) sequence
NNNDRPSGIPDR

SEQ ID NO: 449 - protein, 462 aa, Artificial Sequence
  Synthetic PG121 heavy chain antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 450 - protein, 211 aa, Artificial Sequence
  Synthetic PG121 light chain antibody sequence
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 451 - protein, 132 aa, Artificial Sequence
  Synthetic PG121 heavy chain variable region antibody sequence
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSS

SEQ ID NO: 452 - protein, 106 aa, Artificial Sequence
  Synthetic PG121 light chain variable region antibody sequence
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLG

The invention claimed is:

1. An isolated monoclonal antibody, or an antigen-binding fragment thereof, that binds to human immunodeficiency virus (HIV) gp120, comprising a heavy chain variable region having at least 95%, at least 98%, or at least 99% sequence identity to the heavy chain variable region set forth in SEQ ID NO: 451, and a light chain variable region having at least 95%, at least 98%, or at least 99% sequence identity to the light chain variable region set forth in SEQ ID NO: 452; wherein the heavy chain variable region comprises Asn at position 60, His at position 68, Thr-Gly-Val at positions 82a-82c and Thr at position 105, using Kabat numbering; and wherein the light chain variable region comprises Arg at position 67b and Pro at position 67c, using Kabat numbering.

2. The isolated monoclonal antibody of claim 1, comprising a heavy chain constant region comprising one or more of the following amino acid substitutions in the Fc domain: Ala at position 236, Asp at position 239, Leu at position 330, Glu at position 332, Leu at position 428, and Ser at position 434, using EU numbering.

3. The isolated monoclonal antibody of claim 1, comprising a IgG1m17 allotype heavy chain.

4. The isolated monoclonal antibody of claim 1, comprising a Lambda2 light chain.

5. A pharmaceutical composition comprising the monoclonal antibody or fragment thereof of claim 1, and a pharmaceutically acceptable carrier, excipient or diluent.

6. The pharmaceutical composition of claim 5, wherein the pharmaceutically acceptable carrier, excipient or diluent comprises an aqueous pH-buffered solution and a sugar.

7. The pharmaceutical composition of claim 5, wherein the pharmaceutically acceptable carrier, excipient or diluent comprises an acetate-buffer, a histidine-buffer, a citrate-buffer, a succinate-buffer, a tris-buffer or a phosphate-buffer.

8. The pharmaceutical composition of claim 5, wherein the pharmaceutically acceptable carrier, excipient or diluent comprises a sugar selected from the group consisting of lactose, glucose and sucrose.

9. The pharmaceutical composition of claim 5, wherein the pharmaceutically acceptable carrier, excipient or diluent comprises phosphate buffered saline (PBS) or sodium acetate; and a sugar selected from the group consisting of lactose, glucose and sucrose.

10. The pharmaceutical composition of claim 5, wherein the pharmaceutically acceptable carrier, excipient or diluent comprises sodium acetate and sucrose.

11. The pharmaceutical composition of claim 5, wherein the pharmaceutically acceptable carrier, excipient or diluent comprises phosphate buffered saline (PBS).

12. The pharmaceutical composition of claim 5, further comprising one or more additional therapeutic agents.

13. The pharmaceutical composition of claim 12, wherein the one or more additional therapeutic agents is/are an anti-HIV agent and/or a TLR7 agonist.

14. The pharmaceutical composition of claim 12, wherein the one or more additional therapeutic agents comprises one or more broadly neutralizing antibodies (bNAbs) that provide complementary binding, neutralization or infected cell killing activity.

15. A method of producing the monoclonal antibody or antigen-binding fragment thereof of claim 1, comprising recombinantly expressing the monoclonal antibody or antigen-binding fragment thereof in a host cell.

16. The method of claim 15, wherein the host cell is a eukaryotic cell.

17. The method of claim 15, wherein the host cell is a mammalian cell.

18. The method of claim 15, wherein the host cell is selected from the group consisting of a Chinese Hamster Ovary (CHO) cell, a COS cell, a BEM cells, a NSO cell, a Bowes melanoma cell, a HeLa cell, a 911 cell, an AT1080 cell, an A549 cell, a 293 cell and a HEK293T cell.

* * * * *